(12) United States Patent
Beers et al.

(10) Patent No.: US 9,464,139 B2
(45) Date of Patent: Oct. 11, 2016

(54) GITR ANTIGEN BINDING PROTEINS AND METHODS OF USE THEREOF

(71) Applicant: AMGEN INC., Thousand Oaks, CA (US)

(72) Inventors: Courtney Beers, Seattle, WA (US); Jason C. O'Neill, Brier, WA (US); Ian Foltz, Burnaby (CA); Randal R. Ketchem, Snohomish, WA (US); Julia C. Piasecki, Seattle, WA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

(21) Appl. No.: 14/472,116

(22) Filed: Aug. 28, 2014

(65) Prior Publication Data

US 2015/0064204 A1    Mar. 5, 2015

Related U.S. Application Data

(60) Provisional application No. 61/872,125, filed on Aug. 30, 2013, provisional application No. 62/031,036, filed on Jul. 30, 2014.

(51) Int. Cl.
  *C07K 16/28* (2006.01)
  *A61K 45/06* (2006.01)
  *A61K 39/00* (2006.01)

(52) U.S. Cl.
  CPC ............ *C07K 16/2878* (2013.01); *A61K 45/06* (2013.01); *A61K 2039/505* (2013.01); *C07K 2317/21* (2013.01); *C07K 2317/33* (2013.01); *C07K 2317/41* (2013.01); *C07K 2317/71* (2013.01); *C07K 2317/74* (2013.01); *C07K 2317/76* (2013.01); *C07K 2317/77* (2013.01); *C07K 2317/94* (2013.01)

(58) Field of Classification Search
  CPC .......... C07K 16/2878; C07K 2317/21; C07K 2317/33; C07K 2317/41; C07K 2317/71; C07K 2317/74; C07K 2317/76; C07K 2317/77; C07K 2317/94; A61K 45/06; A61K 2039/505
  See application file for complete search history.

(56) References Cited

U.S. PATENT DOCUMENTS

| | | | |
|---|---|---|---|
| 3,773,919 A | 11/1973 | Boswell et al. |
| 4,399,216 A | 8/1983 | Axel et al. |
| 4,740,461 A | 4/1988 | Kaufman |
| 4,751,180 A | 6/1988 | Cousens et al. |
| 4,816,567 A | 3/1989 | Cabilly et al. |
| 4,912,040 A | 3/1990 | Kaufman et al. |
| 4,935,233 A | 6/1990 | Bell et al. |
| 4,946,778 A | 8/1990 | Ladner et al. |
| 4,959,455 A | 9/1990 | Clark et al. |
| 4,965,195 A | 10/1990 | Namen et al. |
| 4,968,607 A | 11/1990 | Dower et al. |
| 5,011,912 A | 4/1991 | Hopp et al. |
| 5,208,020 A | 5/1993 | Chari et al. |
| 5,260,203 A | 11/1993 | Ladner et al. |
| 5,262,522 A | 11/1993 | Gearing |
| 5,292,658 A | 3/1994 | Cormier et al. |
| 5,416,064 A | 5/1995 | Chari et al. |
| 5,418,155 A | 5/1995 | Cormier et al. |
| 5,426,035 A | 6/1995 | Greene et al. |
| 5,426,048 A | 6/1995 | Gearing |
| 5,475,092 A | 12/1995 | Chari et al. |
| 5,530,101 A | 6/1996 | Queen et al. |
| 5,545,806 A | 8/1996 | Lonberg et al. |
| 5,545,807 A | 8/1996 | Surani et al. |
| 5,569,825 A | 10/1996 | Lonberg et al. |
| 5,585,089 A | 12/1996 | Queen et al. |
| 5,585,499 A | 12/1996 | Chari et al. |
| 5,625,126 A | 4/1997 | Lonberg et al. |
| 5,633,425 A | 5/1997 | Lonberg et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,728,813 A | 3/1998 | Lyman et al. |
| 5,741,668 A | 4/1998 | Ward et al. |
| 5,747,498 A | 5/1998 | Schnur et al. |
| 5,770,429 A | 6/1998 | Lonberg et al. |
| 5,777,079 A | 7/1998 | Tsien et al. |
| 5,789,650 A | 8/1998 | Lonberg et al. |
| 5,804,387 A | 9/1998 | Cormack et al. |

(Continued)

FOREIGN PATENT DOCUMENTS

| | | |
|---|---|---|
| EP | 0 133 988 A2 | 3/1985 |
| EP | 0 058 481 B1 | 10/1986 |
| EP | 0 088 046 B1 | 12/1987 |
| EP | 0 143 949 B1 | 10/1988 |
| EP | 0 036 676 B2 | 9/1990 |

(Continued)

OTHER PUBLICATIONS

Paul, WE. Fundamental Immunology, 3rd ed. Raven Press, NY, Chap. 9, pp. 292-295, 1993.*

(Continued)

*Primary Examiner* — Robert Landsman
(74) *Attorney, Agent, or Firm* — Jonathan M. Dermott

(57) ABSTRACT

Antigen binding proteins that activate GITR are provided. Nucleic acids encoding the antigen binding proteins and vectors and cells containing such nucleic acids are also provided. The antigen binding proteins have value in therapeutic methods in which it is useful to stimulate GITR signaling, thereby inducing or enhancing an immune response in a subject. Accordingly, the antigen binding proteins have utility in a variety of immunotherapy treatments, including treatment of various cancers and infections.

28 Claims, 17 Drawing Sheets

(56) References Cited

U.S. PATENT DOCUMENTS

| | | |
|---|---|---|
| 5,814,318 A | 9/1998 | Lonberg et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 5,969,110 A | 10/1999 | Beckmann et al. |
| 5,981,245 A | 11/1999 | Fox et al. |
| 6,111,090 A | 8/2000 | Gorman et al. |
| 6,162,963 A | 12/2000 | Kucherlapati et al. |
| 6,180,370 B1 | 1/2001 | Queen et al. |
| 6,232,447 B1 | 5/2001 | Cerretti |
| 6,255,458 B1 | 7/2001 | Lonberg et al. |
| 6,270,964 B1 | 8/2001 | Michnick et al. |
| 6,300,129 B1 | 10/2001 | Lonberg et al. |
| 6,340,701 B1 | 1/2002 | Chari et al. |
| 6,372,738 B2 | 4/2002 | Chari et al. |
| 6,413,932 B1 | 7/2002 | Cerretti et al. |
| 6,436,931 B1 | 8/2002 | Chari et al. |
| 6,479,635 B1 | 11/2002 | Anderson et al. |
| 6,503,184 B1 | 1/2003 | Ni et al. |
| 6,509,173 B1 | 1/2003 | Ni et al. |
| 6,521,424 B2 | 2/2003 | Cerretti et al. |
| 6,596,852 B2 | 7/2003 | Cerretti et al. |
| 6,673,986 B1 | 1/2004 | Kucherlapati et al. |
| 6,689,607 B2 | 2/2004 | Ni et al. |
| 6,713,610 B1 | 3/2004 | Kucherlapati |
| 6,727,225 B2 | 4/2004 | Wiley |
| 6,740,511 B1 | 5/2004 | Van Raaij et al. |
| 7,025,962 B1 | 4/2006 | Gorman et al. |
| 7,371,832 B1 | 5/2008 | Tang et al. |
| 7,812,135 B2 | 10/2010 | Smith et al. |
| 8,388,967 B2 | 3/2013 | Smith et al. |
| 8,591,886 B2 | 11/2013 | Ponath et al. |
| 8,709,424 B2 | 4/2014 | Schebye et al. |
| 2002/0042368 A1 | 4/2002 | Fanslow, III et al. |
| 2002/0146389 A1 | 10/2002 | Ashkenazi et al. |
| 2002/0150993 A1 | 10/2002 | Ashkenazi et al. |
| 2003/0162712 A1 | 8/2003 | Cerretti et al. |
| 2004/0009491 A1 | 1/2004 | Birse et al. |
| 2005/0202008 A1 | 9/2005 | Williams et al. |
| 2007/0031402 A1 | 2/2007 | Zhang et al. |
| 2007/0065889 A1 | 3/2007 | Roberts et al. |
| 2007/0098719 A1 | 5/2007 | Smith et al. |
| 2009/0028856 A1 | 1/2009 | Chen et al. |
| 2009/0238823 A1 | 9/2009 | Comeau et al. |
| 2009/0274713 A1 | 11/2009 | Chari et al. |
| 2010/0183631 A1 | 7/2010 | Rothe et al. |
| 2010/0255538 A1 | 10/2010 | Cohen et al. |
| 2012/0189639 A1 | 7/2012 | Schebye et al. |
| 2012/0321646 A1 | 12/2012 | Kohrt et al. |
| 2013/0108641 A1 | 5/2013 | Baurin et al. |
| 2013/0183321 A1 | 7/2013 | Smith et al. |
| 2014/0065152 A1 | 3/2014 | Kwon |
| 2014/0072565 A1 | 3/2014 | Kwon |
| 2014/0072566 A1 | 3/2014 | Kwon |

FOREIGN PATENT DOCUMENTS

| | | |
|---|---|---|
| EP | 0 367 566 B1 | 5/1997 |
| EP | 0 546 073 B1 | 9/1997 |
| EP | 0 460 846 B1 | 2/2002 |
| EP | 2 175 884 A2 | 4/2010 |
| EP | 2 343 320 A1 | 7/2011 |
| EP | 2 473 531 A1 | 7/2012 |
| EP | 2 509 627 A1 | 10/2012 |
| EP | 1 866 339 B1 | 5/2013 |
| JP | 2013-91644 A | 5/2013 |
| JP | 5238936 B2 | 7/2013 |
| WO | 87/05330 A1 | 9/1987 |
| WO | 88/01649 A1 | 3/1988 |
| WO | 89/11540 A1 | 11/1989 |
| WO | 90/04036 A1 | 4/1990 |
| WO | 91/10741 A1 | 7/1991 |
| WO | 92/03918 A1 | 3/1992 |
| WO | 92/15673 A1 | 9/1992 |
| WO | 92/22646 A1 | 12/1992 |
| WO | 93/01227 A1 | 1/1993 |
| WO | 93/10151 A1 | 5/1993 |
| WO | 94/02602 A1 | 2/1994 |
| WO | 94/10308 A1 | 5/1994 |
| WO | 95/07463 A1 | 3/1995 |
| WO | 95/19970 A1 | 7/1995 |
| WO | 96/33735 A1 | 10/1996 |
| WO | 98/01555 A2 | 1/1998 |
| WO | 98/02434 A1 | 1/1998 |
| WO | 98/06842 A1 | 2/1998 |
| WO | 98/14451 A1 | 4/1998 |
| WO | 98/14605 A1 | 4/1998 |
| WO | 98/24893 A2 | 6/1998 |
| WO | 98/24895 A1 | 6/1998 |
| WO | 98/26277 A2 | 6/1998 |
| WO | 99/10494 A2 | 3/1999 |
| WO | 99/49019 A2 | 9/1999 |
| WO | 00/32778 A2 | 6/2000 |
| WO | 02/053596 A2 | 7/2002 |
| WO | 03/002713 A2 | 1/2003 |
| WO | 03/006058 A1 | 1/2003 |
| WO | 03/049758 A1 | 6/2003 |
| WO | 03/086289 A2 | 10/2003 |
| WO | 2004/107618 A1 | 12/2004 |
| WO | 2005/007190 A1 | 1/2005 |
| WO | 2005/007699 A2 | 1/2005 |
| WO | 2005/084390 A2 | 9/2005 |
| WO | 2006/078911 A2 | 7/2006 |
| WO | 2006/105021 A2 | 10/2006 |
| WO | 2009/009116 A2 | 1/2009 |
| WO | 2009/099728 A1 | 8/2009 |
| WO | 2011/028683 A1 | 3/2011 |
| WO | 2011/071871 A1 | 6/2011 |
| WO | 2013/039954 A1 | 3/2013 |
| WO | 2014/089113 A1 | 6/2014 |

OTHER PUBLICATIONS

Rudikoff S. et al. Proc. Natl. Acad. Sci. USA, 79:1979-1983, 1982.*
Colman, PM. Research in Immunology, Elsevier, NY, 145(1):33-36, 1994.*
Chen L, et al. Molecular Therapy. 15(12):2194-2202. 2007. Available online at—doi:10.1038/sj.mt.6300310.*
Nocentini G. and Riccardi C. "Therapeutic Targets of the TNF Superfamily" in Advances in Experimental Medicine and Biology. Edited by Iqbal S. Grewal. Chapter 11. pp. 157-170.*
Baeuerla PA and Reinhardt C. Cancer Research. 69(12):4941-4944. Jun. 15, 2009.*
Opposition Document—R & D Systems—ANtibodies Catalog, WayBackMachine, Copyright 2004, 2 pps., Accessed on the Web on Feb. 7, 2014: http://web.archive.org/web/20041101204308/http://www.rndsystems.com/asp/c_search.asp?ucategory=3&factors=GITR.*
U.S. Appl. No. 60/665,322, filed Mar. 25, 2005, TolerRx, Inc.
U.S. Appl. No. 60/687,265, filed Jun. 3, 2005, TolerRx, Inc.
U.S. Appl. No. 61/732,760, filed Dec. 3, 2012, Bristol-Myers Squibb Co.
U.S. Appl. No. 61/801,187, filed Mar. 15, 2013, Bristol-Myers Squibb Co.
Agostini et al., "The Glucocorticoid-Induced Tumor Necrosis Factor Receptor-Related Gene Modulates the Response to *Candida albicans* Infection," *Infect. Immun.*, 73(11): 7502-7508 (2005).
Aplin, J. D. and Wriston Jr., J. C., "Preparation, Properties, and Applications of Carbohydrate Conjugates of Proteins and Lipids," *CRC Crit. Rev. Biochem.*, pp. 259-306 (1981).
Ashkenazi et al., "Protection against endotoxic shock by a tumor necrosis factor receptor immunoadhesin," *Proc. Natl. Acad. Sci. USA*, 88: 10535-10539 (1991).
Ausubel et al., Short Protocols in Molecular Biology, a Compendium of Methods from Current Protocols in Molecular Biology, Greene Publishing Associates and John , 2$^{nd}$ Edition (1992) (Table of Contents Only).

(56) References Cited

OTHER PUBLICATIONS

Baecher-Allan et al., "Inhibition of Human CD4+CD25+high Regulatory T Cell Function[1]," The Journal of Immunology, pp. 6210-6217, Downloaded from http://www.jimmunol.org/ on Feb. 7, 2014.
Balint et al., "Antibody engineering by parsimonious mutagenesis," Gene, 137: 109-118 (1993).
Baltz et al., "Neutralization of tumor-derived soluble Glucocorticoid-Induced TNFR-Related Protein ligand increases NK cell anti-tumor reactivity," Blood, 112(9): 3735-3743 (2008).
Baum et al., "Molecular characterization of murine and human OX40/OX40 ligand systems: identification of a human OX40 ligand as the HTLV-1-regulated protein gp34," EMBO J., 13: 3992-4001 (1994).
Bianchi, A. A. and McGrew, J. T., "High-Level Expression of Full-Length Antibodies Using Trans-Complementing Expression Vectors," Biotechnol. Bioeng., 84(4): 439-444 (2003).
Binz et al., "Engineering novel binding proteins from nonimmunoglobulin domains," Nat. Biotech., 23(10): 1257-1268 (2005).
Bird et al., "Single-Chain Antigen-Binding Proteins," Science, 242: 423-426 (1988).
Birebent et al., "Suppressive properties of human CD4+CD25+ regulatory T cells are dependent on CTLA-4 expression," Eur. J. Immunol., 34: 3485-3496 (2004).
Bloom et al., "Intrachain disulfide bond in the core hinge region of human IgG4," Protein Science, 6: 407-415 (1997).
Branden, C. and Tooze, J., eds., Introduction to Protein Structure, New York: Garland Publishing, Inc. New York and London (1991) (Table of Contents Only).
Bruggermann et al., "Designer Mice: The Production of Human Antibody Repertoires in Transgenic Animals," Terhorst C., Malvasi F., Albertini A. (eds): Generation of Antibodies by Cell and Gene Immortalization. Year in Immunol. 7: 33-40 (1993).
Byrn et al., "Biological properties of a CD4 immunoadhesin," Nature, 344: 667-670 (1990).
Carrillo et al., "The Multiple Sequence Alignment Problem in Biology," SIAM J. Applied Math. 48: 1073 (1988).
Carter et al., "Humanization of an anti-p185$^{HER2}$ antibody for human cancer therapy," Proc. Natl. Acad. Sci. USA, 89: 4285-4289 (1992) Immunology.
Chalfie et al., "Green Fluorescent Protein as a Marker for Gene Expression," Science, 263: 802-805 (1994).
Chattopadhyay, K. et al., "Assembly and structural properties of glucocorticoid-induced TNF receptor ligand: Implications for function," Proc. Natl. Acad. Sci., 104: 19452-19457 (2007).
Chattopadhyay, K. et al., "Evolution of GITRL immune function: Murine GITRL exhibits unique structural and biochemical properties within the TNF superfamily," Proc. Natl. Acad. Sci., 105(2): 635-640 (2008).
Chen, J. et al., "Immunoglobulin gene rearrangement in B cell deficient mice generated by targeted deletion of the $J_H$ locus," International Immunology, 5(6): 647-656 (1993).
Chen, S. et al., "The use of native cation-exchange chromatography to study aggregation and phase separation of monoclonal antibodies," Protein Sci., 19: 1191-1204 (2010).
Cheung et al., "Epitope-specific antibody response to the surface antigen of duck hepatitis B virus in infected ducks," Virology, 176: 546-552 (1990).
Chothia, C. et al., "Conformations of immunoglobulin hypervariable regions," Nature, 342: 870-883 (1989).
Chothia, C. and Lesk, A. M. et al., "Canonical Structures for the Hypervariable Regions of Immunoglobulins," J. Mol. Biol., 196: 901-917 (1987).
Chou, P. Y. and Fasman, G. D., "Prediction of Protein Conformation," Biochem., 13(2): 222-245 (1974).
Chou, P. Y. and Fasman, G. D., "Conformational Parameters for Amino Acids in Helical, β-Sheet, and Random Coil Regions Calculated from Proteins," Biochemistry, 13(2): 211-222 (1974).
Chou, P. Y. and Fasman, G. D., "Prediction of the Secondary Structure of Proteins From Their Amino Acid Sequence," Adv. Enzymol. Relat. Areas Mol. Biol., 47: 45-148 (1978) (Reference Uploaded in 8 Parts).
Chou, P. Y. and Fasman, G. D., "Empirical Predictions of Protein Conformation," Ann. Rev. Biochem., 47: 251-276 (1978).
Chou, P. Y. and Fasman, G. D. et al., "Prediction of β-Turns," Biophys. J., 26: 367-383 (1979).
Clouthier and Watts, "Cell-specific and context-dependent effects of GITR in cancer, autoimmunity, and infection," Cytokine & Growth Factor Rev-756: pp. 1-16 (2014) http://dx.doi.org/10.1016/j.cytogfr.2013.12.003.
Coligan, John E., ed., Current Protocols in Immunology, New York: John Wiley & Sons (1993) (Table of Contents Only).
Cosman et al., "Cloning, sequence and expression of human interleukin-2 receptor," Nature, 312: 768-771 (1984).
Creighton, Ed., Proteins, Structures and Molecular Principles, W. H. New York: Freeman and Company (1984) (Table of Contents Only).
Davies et al., "Affinity improvement of single antibody VH domains: residues in all three hypervariable regions affect antigen binding," Immunotechnology, 2: 169-179 (1996).
Dayhoff et al., "A Model of Evolutionary Change in Proteins," Atlas of Protein Sequence and Structure, 5(3): Chapter 22, pp. 345-352 (1978).
De Graaf et al., "Expression of scFvs and scFv fusion proteins in eukaryotic cells," Methods Mol. Biol., 178: 379-387 (2002).
Devereux et al., "A comprehensive set of sequence analysis programs for the VAX," Nucl. Acid Res., 12(1): 387-395 (1984) Genetics Computer Group, University of Wisconsin, Madison, WI.
Dittmer et al., "Functional Impairment of CD8+T Cells by Regulatory T Cells during Persistent Retroviral Infection," Immunity, 20: 293-303 (2004).
Duksin et al., "Relationship of the Structure and Biological Activity of the Natural Homologues of Tunicamycin*," J. Biol. Chem., 257: 3105-3109 (1982).
Edge et al., "Deglycosylation of Glycoproteins by Trifluoromethanesulfonic Acid," Anal. Biochem., 118: 131-137 (1981).
Eppstein et al., "Biological activity of liposome-encapsulated murine interferon γ is mediated by a cell membrane receptor," Proc. Natl. Acad. Sci. USA, 82: 3688-3692 (1985).
Evans et al., "Design of Nonpeptidal Ligands for a Peptide Receptor: Cholecystokinin Antagonists," J. Med. Chem., 30: 1229-1239 (1987).
Fanslow et al., "Structural characteristics of CD40 ligand that determine biological function," Semin. Immunol., 6: 267-278 (1994).
Fauchere, "Elements for the Rational Design of Peptide Drugs," Adv. Drug Res., 15: 29-69 (1986).
Fishwild et al., "High-avidity human IgGk monoclonal antibvodies from a novel strain of minilocus transgenic mice," Nature Biotechnology, 14: 845-851 (1996).
Gebauer, M. and Skerra, A., "Engineered protein scaffolds as next-generation antibody therapeutics," Curr. Opin. Chem. Biol., 13(3): 245-255 (2009).
NCBI Database, GenBank Deposit Q9Y5U5 (human amino acid sequence), Created: Apr. 27, 2001, Downloaded from: http://www.ncbi.nlm.nih.gov/protein/13878830/ on Mar. 4, 2016.
NCBI Database, GenBank AF109216 (murine nucleic acid and amino acid sequences), Downloaded from: http://www.ncbi.nlm.nih.gov/nuccore/AF109216 on Mar. 4, 2016.
GenBank Accession No. U55762, Clontech Labs., Inc. Downloaded from: http://www.ncbi.nlm.nih.gov/nuccore/U55762 on Mar. 4, 2016.
Gennaro, A. R., ed., Remington's Pharmaceutical Sciences, 18$^{th}$ Edition, Mark Publishing Company (1990) (Table of Contents Only).
Goeddel, D. V., ed., Methods Enzymol., Gene Expression Technology, New York: Academic Press. vol. 185 (1990) (Table of Contents Only).

(56) References Cited

OTHER PUBLICATIONS

Golub, E. S. and Green, D. R., eds, *Immunology,-A Synthesis*, 2nd Edition, Sinauer Associates: Sunderland, Mass (1991) (Table of Contents Only).
Gribskov, M. and Devereux, J., eds., *Sequence Analysis Primer*, New York: M. Stockton Press (1991) (Table of Contents Only).
Griffin, A. M. and Griffin, H. G., eds., *Computer Analysis of Sequence Data, Part I*, New Jersey: Humana Press (1994) (Table of Contents Only).
Gurney et al., "Identification of a new member of the tumor necrosis factor family and its receptor, a human ortholog of mouse GITR," *Current Biology*, 9(4): 215-218 (1999).
Hanabuchi et al., "Human plasmacytoid predendritic cells activate NK cells through glucocorticoid-induced tumor necrosis factor receptor-ligand (GITRL)," *Blood*, 107(9): 3617-3623 (2006).
Harding and Lonberg, "Class Switching in Human Immunoglobulin Transgenic Mice," *Ann. N.Y. Acad. Sci.*, 764: 536-546 (1995).
Harlow and Lane, eds., *Antibodies: A Laboratory Manual*, Cold Spring Harbor Press, Cold Spring Harbor, NY (1988) (Table of Contents Only).
Haugland, Richard P., *Molecular Probes Handbook, A Guide to Florescent Probes and Labeling Technologies*, 11th Edition, Johnson, I. and Spence, M. T. Z., Eds. (2010) (Table of Contents Only).
Hawkins et al., "Selection of Phage Antibodies by Binding Affinity Mimicking Affinity Maturation," *J. Mol. Biol.*, 226: 889-896 (1992).
Heim et al., "Engineering green fluorescent protein for improved brightness, longer wavelengths and fluorescence resonance energy transfer," *Curr. Biol.*, 6: 178-182 (1996).
Henikoff et al., "Amino acid substitution matrices from protein blocks," *Proc. Natl. Acad. Sci. USA*, 89: 10915-10919 (1992).
Hollenbaugh et al., "Construction of Immunoglobulin Fusion Proteins," *Current Protocols in Immunology*, Suppl. 4, pp. 10.19A.1-10.19A.11 (2002).
Holt et al., "Domain antibodies: proteins for therapy," *Trends in Biotechnology*, 21(11): 484-490 (2003).
Honegger, A. and Puluckthun, A., "Yet Another Numbering Scheme for Immunoglobulin Variable Domains: An Automatic Modeling and Analysis Tool," *J. Mol. Biol.*, 309: 657-670 (2001).
Hoogenboom, H. R. and Winter, G., "By-passing Immunisation, Human Antibodies from Synthetic Repertoires of Germline $V_H$ Gene Segments Rearranged in Vitro," *J. Mol. Biol.*, 227: 381-388 (1992).
Hopp et al., "A Short Polypeptide Marker Sequence Useful for Recombinant Protein Identification and Purification," *Bio/Technology*, 6: 1204-1210 (1988).
Hoppe et al., "A parallel three stranded α-helical bundle at the nucleation site of collagen triple-helix formation," *FEBS Letters*, 344: 191 (1994).
Huston et al., "Protein engineering of antibody binding sites: Recovery of specific activity in an anti-digoxin single-chain Fv analogue produced in *Escherichia coli*," *Proc. Natl. Acad. Sci. USA*, 85: 5879-5883 (1988).
Ichiki et al., "Regulation of the expression of human C epsilon germline transcript. Identification of a novel IL-4 responsive element," *J. Immunol.*, 150: 5408-5417 (1993).
Jakobovits et al., "Germ-line transmission and expression of a human-derived yeast artificial chromosome," *Nature*, 362: 255-258 (1993).
Jakobovits et al., "Analysis of homozygous mutant chimeric mice: Deletion of the immunoglobulin heavy-chain joining region blocks B-cell development and antibody production," *Proc. Natl. Acad. Sci. USA*, 90: 2551-2555 (1993).
Jalkanen et al., "Heparan sulfate proteoglycans from mouse mammary epithelial cells: localization on the cell surface with a monoclonal antibody," *J. Cell. Biol.*, 101: 976-985 (1985).
Jalkanen et al., "Cell Surface Proteoglycan of Mouse Mammary Epithelial Cells is Shed by Cleavage of Its Matrix-binding Ectodomain from Its Membrane-associated Domain," *J. Cell Biol.*, 105: 3087-3096 (1987).
Jones et al., "Replacing the complementarity-determining regions in a human antibody with those from a mouce," *Nature*, 321: 522-525 (1986).
Kabat Sequences of Proteins of Immunological Interest, NIH, Bethesda, MD (1987) (Table of Contents Only).
Kabat Sequences of Proteins of Immunological Interest, NIH, Bethesda, MD (1991) (Table of Contents Only).
Kanamaru et al., "Costimulation via Glucocorticoid-Induced TNF Receiptor in Both Conventional and CD25+ Regulatory CD4+ T Cells[1]," *J Immunol.*, 172: 7306-7314 (2004).
Kennett et al. (eds.), Monoclonal Antibodies, Hybridomas: A New Dimension in Biological Analysis, Plenum Press, New York (1980) (Table of Contents Only).
Kirkland et al., "Analysis of the fine specificity and cross-reactivity of monoclonal anti-lipid A antibodies,"*J. Immunol.* 137: 3614-3619 (1986).
Ko et al., "Treatment of advanced tumors with agonistic anti-GITR mAb and its effects on tumor-infiltrating Foxp3$^+$CD25$^+$CD4$^+$ regulatory T cells," *Journal of Experimental Medicine*, 202(7): 885-891 (2005) including Corrected Figure 1A downloaded on Jun. 12, 2013 from: jem.rupress.org, 1 pg.
Kohler, G. and Milstein, C., "Continuous cultures of fused cells secreting antibody of predefined specificity," *Nature* 256: 495-497 (1975).
Kortt et al., "Single-chain Fv fragments of anti-neuraminidase antibody NC10 containing five- and ten-residue linkers form dimers and with zero-residue linker a trimer," *Prot. Eng.*, 10: 423 (1997).
Kortt et al., "Dimeric and trimeric antibodies: high avidity scFvs for cancer targeting," *Biomol. Eng.*, 18: 95-108 (2001).
Kostelny et al., "Formation of a Bispecific Antibody by the use of Leucine Zippers," *J. Immunol.*, 148(5): 1547-1553 (1992).
Kriangkum et al., "Bispecific and bifunctional single chain recombinant antibodies," *Biomol. Eng.*, 18: 31-40 (2001).
Landschulz et al., "The Leucine Zipper: A Hypothetical Structure Common to a New Class of DNA Binding Proteins," *Science*, 240: 1759 (1988).
Langer et al., "Biocompatibility of polymeric delivery systems for macromolecules," *J. Biomed. Mater. Res.* 15: 267-277 (1981).
Langer, R., "Controlled release of macromolecules," *ChemTech.*, 12: 98-105 (1982).
Lantto et al., "Chain Shuffling to Modify Properties of Recombinant Immunoglobulins," *Methods Mol. Biol.*, 178: 303-316 (2002).
Lesk, A. M., ed., *Computational Molecular Biology*, New York: Oxford University Press (1988) (Table of Contents Only).
Little et al., "Of mice and men: hybridoma and recombinant antibodies," *Immunology Today*, 21(8): 364-370 (2000).
Lonberg et al., "Antigen-specific human antibodies from mice comprising four distinct genetic modifications," *Nature*, 368: 856-859 (1994).
Lonberg "Transgenic Approaches Monoclonal Antibodies," *The Pharmacology of Monoclonal Antibodies*, Rosenberg, M. and Moore, G. P. Editors, Springer-Verlag, Berlin Heidelberg New York London Paris Tokyo Hong Kong Barcelona Budapest, Chapter 3,: 49-101 (1994).
Lonberg, N. and Huzar, D., "Human Antibodies from Transgenic Mice," *Intern. Rev. Immunol.*, 13: 65-93 (1995).
Mahesh et al., "Expression of GITR ligand abrogates immunosuppressive function of ocular tissue and differentially modulates inflammatory cytokines and chemokines," *Eur. J. Immunol.*, 36: 2128-2138 (2006).
Maniatis et al., "Regulation of Inducible and Tissue-Specific Gene Expression," *Science*, 236: 1237-1244 (1987).
Marks et al., "By-passing Immunization, Human Antibodies from V-gene Libraries Displayed on Phage," *J. Mol. Biol.*, 222: 581-597 (1991).
Marks et al., "By-Passing Immunization: Building High Affinity Human Antibodies by Chain Shuffling," *Biotechnology*, 10: 779-783 (1992).
McHugh et al., "CD4+CD25+ Immunoregulatory T Cells: Gene Expression Analysis Reveals a Functional Role for the Glucocorticoid-Induced TNF Receptor," *Immunity*, 16: 311-323 (2002).

(56) References Cited

OTHER PUBLICATIONS

Mendez et al., "Functional transplant of megabase human immunoglobulin loci recapitulates human antibody response in mice," *Nature Genetics*, 15: 146-156 (1997).

Moldenhauer et al., "Identity of HML-1 Antigen on Intestinal Intraepithelial T Cells and of B-ly7 Antigen on Hairy Cell Leukaemia," *Scand. J. Immunol.*, 32: 77-82 (1990).

Morel et al., "Monoclonal antibodies to bovine serum albumin: affinity and specificity determinations,"*Molec. Immunol.*, 25: 7-15 (1988).

Morrison et al., "Chimeric human antibody molecules: Mouse antigen-binding domains with human constant region domains," *Proc. Natl. Acad. Sci. USA*, 81: 6851-6855 (1984).

Moult, J. "The current state of the art in protein structure prediction," *Curr. Op. in Biotech.*, 7: 422-427 (1996).

Needleman et al., "A General Method Applicable to the Search for Similarities in the Amino Acid Sequence of Two Proteins," *J. Mol. Biol.*, 48: 443-453 (1970).

Nocentini et al., "GITR/GITRL: More than an effector T cell co-stimulatory system," *Eur. J. Immunol.*, 37: 1165-1169 (2007).

Nocentini and Riccardi, "GITR: a multifaceted regulator of immunity belonging to the tumor necrosis factor receptor superfamily," *Eur. J. Immunol.*, 35: 1016-1022 (2005).

Nocentini et al., "A new member of the tumor necrosis factor/nerve growth factor receptor family inhibits T cell receptor-induced apoptosis," *Proc. Natl. Acad. Sci. USA*, 94: 6216-6221 (1997) Cell Biology.

Nolan et al., "Fluorescence-activated cell analysis and sorting of viable mammalian cells based on beta-D-galactosidase activity after transduction of *Escherichia coli* lacZ," *Proc. Natl. Acad. Sci. USA*, 85: 2603-2607 (1988).

Opposition Document—Haseltine Lake LLP Letter to the European Patent Office, dated Nov. 18, 2010, re: EP Patent Application No. 06748745.4, 10 pgs.

Opposition II Document—European Application No. 06 748 745.4, Interlocutory decision in Opposiiton proceedings, dated May 9, 2016, 17 pages.

Opposition II Document—European Application No. 06 748 745.4, Response to Amgen Inc. to the Proprietor's Observations to the Notices of Opposition, dated Mar. 4, 2015, 15 pages.

Opposition II Document—European Application No. 06 748 745.4, Summary of Facts and Submissions, dated Jul. 10, 2015, 16 pages.

Paul, W., ed., "Evolution of the Immune System," *Fundamental Immunology*, 2nd ed., Chapter 7, pp. 139-165, New York: Raven Press.

Reichert, J. M., "Monoclonal antibodies in the clinic," *Nature Biotechnology*, 19: 819-822 (2001).

Riechmann et al., "Reshaping human antibodies for therapy," *Nature*, 332: 323-327 (1988).

Rizo, J. and Gierasch, L. M., "Constrained Peptides: Models of Bioactive Peptides and Protein Substructures," *Ann. Rev. Biochem.*, 61: 387-418 (1992).

Ronchetti et al., "GITR, a member of the TNF receptor superfamily, is costimulatory to mouse T lymphocyte subpopulations," *Eur. I Immunol.*, 34: 613-622 (2004).

Sambrook, Fritsch, and Maniatis, *Molecular Cloning: A Laboratory Manual*, 3rd Ed., Cold Spring Harbor Laboratory Press, Cold Spring Harbor, NY (2001) (Table of Contents Only).

Shimizu et al., "Stimulation of $CD25^+CD4^+$ regulatory T cells through GITR breaks immunological self-tolerance," *Nature Immunology*, 3(2): 135-142 (2002).

Sidman et al., "Controlled Release of Macromolecules and Pharmaceuticals from Synthetic Polypeptides Based on Glutamic Acid," *Biopolymers*, 2: 547-556 (1983).

Smith, D. W., ed., *Biocomputing, Informatics and Genome Projects*, New York: Academic Press (1993) (Table of Contents Only).

Sojar, Hakimuddin T. et al., "A Chemical Method for the Deglycosylation of Proteins," *Arch. Biochem. Biophys.*, 259(1): 52-57 (1987).

Songsivilai, S. and Lachmann, P. J., "Bispecific antibody: a tool for diagnosis and treatment of disease," *Clin. Exp. Immunol.*, 79: 315-321 (1990).

Stahli et al., "Distinction of Epitopes by Monoclonal Antibodies,"*Methods in Enzymology*, 92: 242-253 (1983).

Stauber, "Development and Applications of Enhanced Green Fluorescent Protein Mutants," *Biotechniques*, 24: 462-471 (1998).

Taylor et al., "A transgenic mouse that expresses a diversity of human sequence heavy and light chain immunoglobulins," *Nucleic Acids Research*, 20(23): 6287-6295 (1992).

Taylor et al., "Human immunoglobulin transgenes undergo rearrangement, somatic mutation and class switching in mice that lack endogenous IgM," *International Immunology*, 6(4): 579-591 (1994).

Thornton et al., "Prediction of progress at last," *Nature*, 354: 105-106 (1991).

Thotakura et al., "Enzymatic Deglycosylation of Glycoproteins,"*Meth. Enzymol.*, 138: 350-359 (1987).

Tijssen, "Outlines of the strategies for enzyme immunoassays," *Practice and Theory of Enzyme Immunoassays*, R. H. Burdon and P. H. van Knippenberg, Eds., Elsevier, Amsterdam, vol. 15, Chapter 2, pp. 9-20 (1993).

Tuaillon et al., "Biased Utilization of $D_{HQ52}$ and $J_H4$ Gene Segments in a Human Ig Transgenic Minilocus is Independent of Antigenic Selection," *J. Immunol.*, 152: 2912-2920, (1994).

Turk et al., "Concomitant Tumor Immunity to a Poorly Immunogenic Melanoma is Prevented by Regulatory T Cells," *The Journal of Experimental Medicine*, 200(6): 771-782 (2004).

Veber, D. F. and Freidinger, R. M., "The design of metabolically-stable peptide analogs," *TINS*, pp. 392-396 (1985).

Verhoeyen et al., "Reshaping Human Antibodies: Grafting an Antilysozyme Activity," *Science*, 239: 1534-1536 (1988).

Von Heinje, G., Sequence Analysis in Molecular Biology, New York: Academic Press (1987) (Table of Contents Only).

Voss et al., "The role of enhancers in the regulation of cell-type-specific transcriptional control," *Trends Biochem. Sci.*, 11: 287-289 (1986).

Ward et al., "Binding activities of a repertoire of single immunoglobulin variable domains secreted from *Escherichia coli*," *Nature*, 341: 544-546 (1989).

Whiteside, S. T. and Israël, A., "IkB proteins: structure, function and regulation," *Cancer Biology*, 8: 75-82 (1997).

Woodward, J. et al., "Nondenaturing Size-Exclusion Chromatography-Mass Spectrometry to Measure Stress-Induced Aggregation in a Complex Mixture of Monoclonal Antibodies," *Anal. Chem.*, 85: 6429-6436 (2013).

Yan, Ziying et al., "Inverted terminal repeat sequences are important for intermolecular recombination and circularization of adeno-asosciated virus genomes," *Journal of Virology, The American Society for Microbiology*, US, 79(1): 364-379 (2005).

Yang et al., "CDR Walking Mutagenesis for the Affinity Maturation of a Potent Human Anti-HIV-1 Antibody into the Picomolar Range," *J. Mol. Biol.*, 254: 392-403 (1995).

Zola, H. "Using Monoclonal Antibodies. Soluble Antigens," *Monoclonal Antibodies: A Manual of Techniques*, Chapter 6, pp. 147-158 (1987).

\* cited by examiner

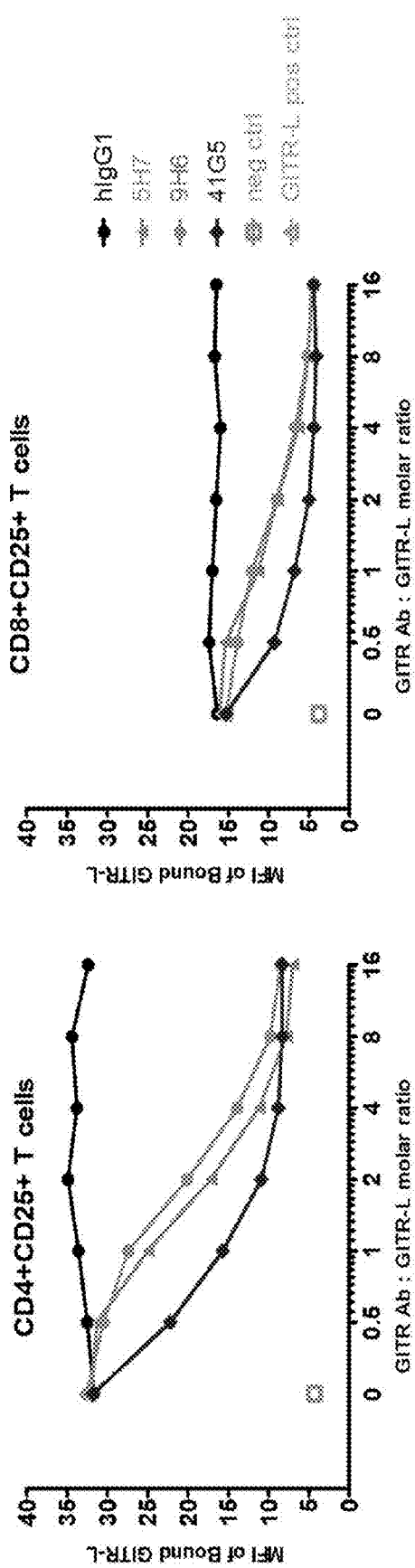

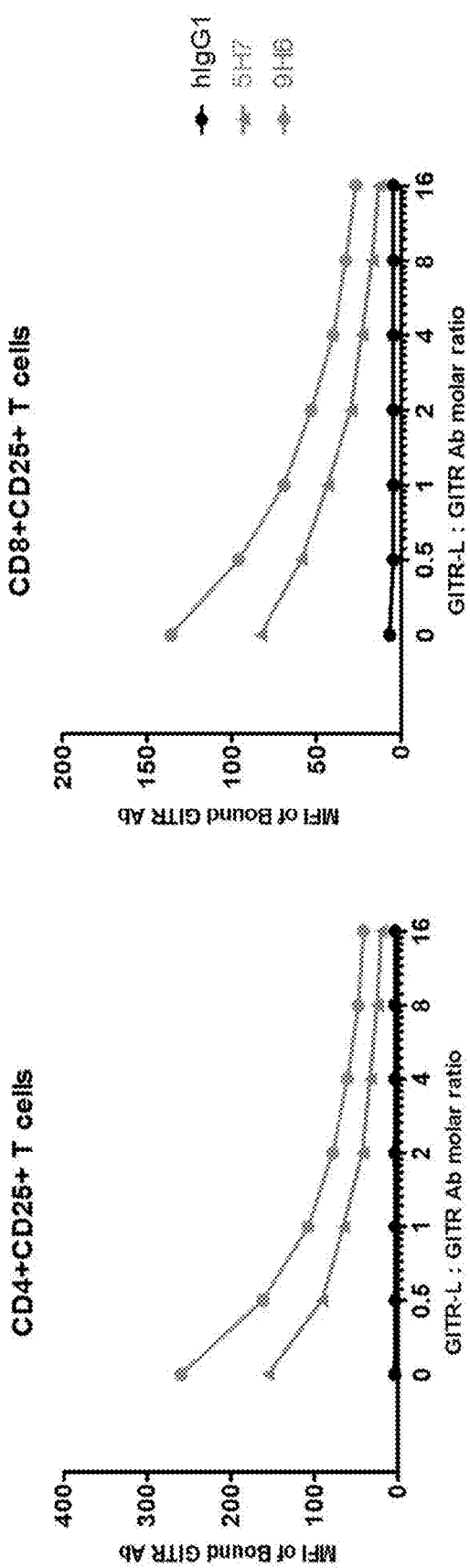

| ID No. | KAPPA VARIABLE | | | | | |
|---|---|---|---|---|---|---|
| | Ref. No. | Antibody | FR1 | CDR1 | FR2 | CDR2 |
| Ab1 | SS-10942_LC | 1D7 | DIQMTQSPSSLSASVGDRVTITC | RAS--QGIR-------NDLG | WYQQKPGKAPKRLIY | D-------ASSLQS |
| Ab2 | SS-12413_LC | 33C9 | DIQMTQSPSSLSASVGDRVTITC | RAS--QGIR-------NDLG | WYQQKPGKAPKRLIY | D-------ASSLQS |
| Ab3 | SS-12414_LC | 33F6 | DIQMTQSPSSLSASVGDRVTITC | RAS--QGIR-------NDLG | WYQQKPGKAPKRLIY | A-------ASSLQS |
| Ab4 | SS-12415_LC | 34G4 | DIQMTQSPSSLSASVGDRVTITC | RAS--QGIR-------NDLG | WYQQKPGKAPKRLIY | D-------ASTLQS |
| Ab5 | SS-12416_LC | 35B10 | DIQMTQSPSSLSASVGDRVTVTC | RAS--QGIR-------NDLG | WYQQKPGKAPKRLIY | A-------ASTLQS |
| Ab7 | SS-12428_LC | 41G5 | DIQMTQSPSSLSASVGDRVTITC | RAS--QGIR-------NDLG | WYQQKPGKAPKRLIY | A-------ASSLQS |
| Ab8 | SS-12418_LC | 42A11 | DIQMTQSPSSLSASVGDRVTITC | RAS--QGIR-------NDLG | WYQQKPGKAPKRLIY | D-------ASSLQS |
| Ab11 | SS-12421_LC | 46 E11 | DIQMTQSPSSLSASVGDRVTITC | RAS--QGIR-------NDLG | WYQQKPGKAPKRLIY | A-------ASSLQS |
| Ab12 | SS-12422_LC | 48H12 | DIQMTQSPSSLSASVGDRVTITC | RAS--QGIR-------NDLG | WYQKPGKAPKRLIY | A-------ASSLQS |
| Ab14 | SS-12424_LC | 49D9 | DIQMTQSPSSLSASVGDRVTITC | RAS--QGIR-------NDLG | WYQQKPGKAPKRLIY | A-------ASSLQS |
| Ab18 | SS-10944_LC | 7A10 | DIQMTQSPSSLSASVGDRVTITC | RAS--QGIR-------NDLG | WYQQKPGKAPKRLIY | A-------ASSLQS |
| Ab19 | SS-10945_LC | 9H6 | DIQMTQSPSSLSASVGDRVTITC | RAS--QGIR-------NDLG | WYQQKPGKAPNRLIY | A-------TSSLQS |
| Ab6 | SS-12417_LC | 41 E11 | DIQMTQSPSSLSASVGDRVTITC | RAS--QVIR-------NDLG | WYQQKPGKAPKRLIY | A-------ASSLQS |
| Ab13 | SS-12423_LC | 48H7 | DIQMTQSPSSLSASVGDRVTITC | RAS--QVIR-------NDLG | WYQQKPGKAPKRLIY | A-------ASSLQS |
| Ab16 | SS-12427_LC | 48A9 | DIQMTQSPSSLSASVGDRVIITC | RAS--QSIS-------SYLH | WYKQPGKAPKLLIY | G-------ASRLQS |
| Ab17 | SS-10943_LC | 5H7 | EIVLTQSPGTLSLSPGERATLSC | RAS--QTVSS------NYLA | WYQQKPGQAPRLLIY | G-------SSTRAT |
| | LAMBDA VARIABLE | | | | | |
| Ab9 | SS-12419_LC | 44C1 | QSALTQP-ASVSGSPGQSITISC | TGTS--SDVGTY----NLVS | WYQQHPGKAPKLMIY | E-------VSKRPS |
| Ab10 | SS-12420_LC | 45A8 | QSALTQP-ASVSGSPGQSITISC | TGTS--SDVGTY----NLVS | WYQQHPGKAPKLMIY | E-------VSKRPS |
| Ab15 | SS-12425_LC | 49 E2 | QSALTQP-ASVSGSPGQSITISC | TGTS--SDVGTY----NLVS | WYQQHPGKAPKLMIH | E-------VSKRPS |

FIG. 8A

| ID No. | KAPPA VARIABLE | | | | | |
|---|---|---|---|---|---|---|
| | Ref. No. | Antibody | FR3 | CDR3 | FR4 | SEQ ID |
| Ab1 | SS-10942_LC | 1D7 | GVPSRFSGSGSG--TEFTLTISSLQPEDFATYYC | LQHNN-----------YPWT | FGQGTKVEIKR | 118 |
| Ab2 | SS-12413_LC | 33C9 | GVPSRFSGSGSG--TEFTLTISSLQPEDFATYYC | LQHHS-----------YPWT | FGQGTKVEIKR | 119 |
| Ab3 | SS-12414_LC | 33F6 | GVPSRFSGSGSG--TEFTLTVSSLQPEDFATYYC | LQLNS-----------YPWT | FGQGTKVEIKR | 120 |
| Ab4 | SS-12415_LC | 34G4 | GVPSRFSGSGSG--TDFTLTISSLQPEDFATYYC | LQLNS-----------YPWT | FGQGTKVEIKR | 121 |
| Ab5 | SS-12416_LC | 35B10 | GVPSRFSGSGSG--TEFTLTISSLQPEDFATYYC | LQHNN-----------YPWT | FGQGTKVEIKR | 122 |
| Ab7 | SS-12428_LC | 41G5 | GVPSRFSGSGSG--TEFTLTISSLQPEDFATYYC | LQHNN-----------YPWT | FGQGTKVDIKR | 124 |
| Ab8 | SS-12418_LC | 42A11 | GVPSRFSGSGSG--TDFTLTISSLQPEPATYYC | LQHNN-----------YPWT | FGQGTKVEIKR | 125 |
| Ab11 | SS-12421_LC | 46 E11 | GVPSRFSGSGSG--AEFTLTISSLQPEDFATYYC | LQHNS-----------YPWT | FGQGTKVEIKR | 128 |
| Ab12 | SS-12422_LC | 48H12 | GVPSRFSGSGSG--TEFTLTISSLQPEDFATYYC | LQHNN-----------YPWT | FGQGTKVEIKR | 129 |
| Ab14 | SS-12424_LC | 49D9 | GVPSRFSGSGSG--TEFTLTISSLQPEDFATYYC | LQLNS-----------YPWT | FGQGTKVEIKR | 131 |
| Ab18 | SS-10944_LC | 7A10 | GVPSRFSGSGSG--TEFTLTISSLQPEDFATYYC | QQHNS-----------YPWT | FGQGTKVEIKR | 135 |
| Ab19 | SS-10945_LC | 9H6 | GVPSRFSGSGSG--TEFTLTISSLQPEDFATYYC | LQHNT-----------YPWT | FGQGTKVEIKR | 136 |
| Ab6 | SS-12417_LC | 41 E11 | GVPSRFSGSGSG--TEFTLTISSLQPEDFATYYC | LQHNS-----------YPLT | FGGGTKVEIKR | 123 |
| Ab13 | SS-12423_LC | 48H7 | GVPSRFSGSGSG--TEFTLTISSLQPEDFATYYC | LQHNS-----------YPIT | FGGGTKVEIKR | 130 |
| Ab16 | SS-12427_LC | 48A9 | GVPSRFSGSGSG--TDFTLTISSLQPEDFATYYC | QQSSS-----------TPLT | FGGGTKVEIKR | 133 |
| Ab17 | SS-10943_LC | 5H7 | GVPSRFSGSGSG--TDFTLTISRLEPEDFAVYYC | QQYDS-----------SPWT | FGQGTKVEIKR | 134 |
| LAMBDA VARIABLE | | | | | | |
| Ab9 | SS-12419_LC | 44C1 | GVSNRFSGSKSG--NTASLTISGLQAEDEADYYC | CSYAGF----------STWV | FGGGTKLTVLG | 126 |
| Ab10 | SS-12420_LC | 45A8 | HISNRFSGSKSG--NTASLTISGLQAEDEADYYC | CSYAGY----------STWV | FGGGTKLTVLR | 127 |
| Ab15 | SS-12425_LC | 49 F2 | GVSNRFSGSKSG--NTASLTISGLQAEDEADYYC | CSYAGI----------STWV | FGGGTKLTVLG | 132 |

FIG. 8B

| ID No. | HEAVY VARIABLE | | | | | |
|---|---|---|---|---|---|---|
| | Ref. No. | Antibody | FR1 | CDR1 | FR2 | CDR2 |
| Ab1 | SS-10942_HC | 1D7 | QVQLVES-GGGVVQPGRSLRLSCAASG-FTFS | S-----YGMH | WVRQAPGKGLEWVT | VIWYE---GSNKYYADSVKG |
| Ab6 | SS-12417_HC | 41E11 | QVQVVES-GGGVVQPGRSLRLSCAASG-FTFS | S-----YGMY | WVRQAPGKGLEWVA | VIWYE---GSNKYYADSVRG |
| Ab2 | SS-12413_HC | 33C9 | QVQVVES-GGGVVQPGRSLRLSCAASG-FTFS | S-----YGMH | WVRQAPGKGLEWVS | VIWYE---GSNKYYADSVKG |
| Ab4 | SS-12415_HC | 34G4 | QVQLVES-GGGVVQPGRSLRLSCAASG-FTFS | S-----YGMH | WVRQAPGKGLEWVA | VIWYE---GSNKYYADSVKG |
| Ab7 | SS-12428_HC | 41G5 | QVQLVES-GGGVVQPGRSLRLSCAASG-FTFS | G-----YGMH | WVRQAPGKGLEWVA | VIWYP---GSNKYYADSVKG |
| Ab8 | SS-12418_HC | 42A11 | QVQLVES-GGGVVQPGRSLRLSCAASG-FTFS | S-----YGMH | WVRQAPGKGLEWVA | VIWYE---GSNKYYADSVKG |
| Ab13 | SS-12423_HC | 48H7 | QMQLVES-GGGVVQPGRSLRLSCAASG-FTFS | S-----YGMY | WVRQAPGKGLEWVA | VIWYE---GSNKYYADSVKG |
| Ab14 | SS-12424_HC | 49D9 | QVQLVES-GGGVVQPGRSLRLSCAASG-FTFS | S-----YGMH | WVRQAPGKGLEWVA | VIWYA---GSNKYYADSVKG |
| Ab18 | SS-10944_HC | 7A10 | QVQLVES-GGGVVQPGRSLRLSCAASG-FTFS | S-----YGMH | WVRQAPGKGLEWMA | VIWYV---GSNKYYADSVKG |
| Ab19 | SS-10945_HC | 9H6 | QVQLVES-GGGVVQPGRSLRLSCVASG-FTFS | S-----YGMH | WIRQAPGKGLEWVA | VIWYE---GSNKYYADSVKG |
| Ab3 | SS-12414_HC | 33F6 | QVQLVES-GGGVVQPGRSLRLSCAASG-FTFS | N-----YGMH | WVRQAPGKGLEWVA | VIWYV---GSNKYYADSVKG |
| Ab5 | SS-12416_HC | 35B10 | QVQLVES-GGGVVQPGRSLRLSCAASG-FTFS | S-----YGMH | WVRQAPGKGLEWVA | VIWYA---GSNKYYADSVKG |
| Ab9 | SS-12419_HC | 44C1 | QVQLVES-GGGVVQPGRSLRLSCAASG-FTLS | S-----YGMH | WVRQAPGKGLEWVA | VIWYD---GSNKYYADSVKG |
| Ab10 | SS-12420_HC | 45A8 | QVQLVES-GGGVVQPGRSLRLSCAASG-FTFS | S-----YGMH | WVRQAPGKGLEWVA | VIWHD---GSNKYYADSVKG |
| Ab11 | SS-12421_HC | 46E11 | QVQLVES-GGGVVQPGRSLRLSCAASG-FTFS | S-----YGMH | WVRQAPGKGLEWVA | VIWYA---GSNKYYADSVKG |
| Ab12 | SS-12422_HC | 48H12 | QVQLVES-GGGVVQPGRSLRLSCAASG-FTFS | S-----YGMH | WVRQAPGKGLEWVA | VIWYA---GSNKYYADSVKG |
| Ab15 | SS-12425_HC | 49E2 | QVQLVES-GGGVVQPGRSLRLSCAASG-FTFS | S-----YGMH | WVRQAPGKGLEWVA | VIWSD---GNNKYYEDSVKG |
| Ab16 | SS-12427_HC | 48A9 | QVQLVES-GGGVVQPGRSLRLSCAASG-FTFS | S-----CGMH | WVRQAPGKGLEWVA | VISYD---GSNKYYADSVKG |
| Ab17 | SS-10943_HC | 5H7 | QVQLQES-GPGLVKPSQTLSLTCTVSG-GSIS | SG-----GYFWS | WIRQHPGKGLEWIG | YIYY----SGTTYYNPSLKS |

FIG. 9A

| ID No. | Ref. No. | Antibody | FR3 | CDR3 | FR4 | SEQ ID |
|---|---|---|---|---|---|---|
| Ab1 | SS-10942_HC | 1D7 | RFTISRDNSKNTLYLQMNSLRAEDTAVYYCAR | GGQLGK--------YYYYGMDV | WGQGTTVTVSS | 137 |
| Ab6 | SS-12417_HC | 41E11 | RFTISRDNSKNTLYLQMNSLRAEDTALYYCAR | GGQLGK--------DYYSGMDV | WGQGTTVTVSS | 142 |
| Ab2 | SS-12413_HC | 33C9 | RFTISRDNSKNTLYLQMNSLRAEDTAVYYCAR | GGLLGY--------YYYYGMDV | WGQGTTVTVSS | 138 |
| Ab4 | SS-12415_HC | 34G4 | RFTISRDNSKNTLYLQMNSLRAEDTAVYYCAR | GGQLGY--------YYYYGMDV | WGQGTTVTVSS | 140 |
| Ab7 | SS-12428_HC | 41G5 | RFTISRDNSKNTLYLQMNSLRAEDTAVYYCAR | GGELGR--------YYYYGMDV | WGQGTTVTVSS | 143 |
| Ab8 | SS-12418_HC | 42A11 | RFTISRDNSKNTLYLQMNSLRAEDTAVYYCAR | GGQLGY--------YYYSGMDV | WGQGTTVTVSS | 144 |
| Ab13 | SS-12423_HC | 48H7 | RFTISRDNSKNTLYLQMNSLRAEDTAVYFCAR | GGELGR--------DYYSGMDV | WGQGTTVTVSS | 149 |
| Ab14 | SS-12424_HC | 49D9 | RFTISRDNSKNTLYLQMNSLRAEDTAVYYCAR | GGRLGF--------YYYYGMDV | WGQGTTVTVSS | 150 |
| Ab18 | SS-10944_HC | 7A10 | RFTISRDNSKNTLYLQMNSLSAEDTAVYYCAR | GGELGR--------DYYSGMDV | WGQGTTVTVSS | 154 |
| Ab19 | SS-10945_HC | 9H6 | RFTISRDNSKNTLYLQMNSLRAEDTAVYYCAR | GGRLGK--------DYYSGMDV | WGQGTTVTVSS | 155 |
| Ab3 | SS-12414_HC | 33F6 | RFTISRDNSKNTLYLQMNSLRAEDTAVYYCAR | GGELRL--------YYYYGMDV | WGQGTTVTVSS | 139 |
| Ab5 | SS-12416_HC | 35B10 | RFTISRDNSKNTLYLQMNSLRAEDTAVYYCAR | GGELSF--------YYYYGMDV | WGQGTTVTVSS | 141 |
| Ab9 | SS-12419_HC | 44C1 | RFTISRDNSKNTLYLQMNSLRAEDTAVYYCAR | RGTVT---------TPEFDY | WGQGTLVTVSS | 145 |
| Ab10 | SS-12420_HC | 45A8 | RFTISKDNSKNTLYLQMNSLRAEDTAVYYCAR | EYG-----------GNFDY | WGQGTLVTVSS | 146 |
| Ab11 | SS-12421_HC | 46E11 | RFTISRDNSKNTLYLQMNSLRAEDTAVYYCAR | GDILTGY-------SLYYGMDV | WGQGTTVTVSS | 147 |
| Ab12 | SS-12422_HC | 48I112 | RFTISRDNSKNTVYLQMNSLRAEDTAVYYCAR | GGQLAL--------YYYYGMDV | WGQGTTVTVSS | 148 |
| Ab15 | SS-12425_HC | 49E2 | RFTISRDSSKNTLFLQMNSLRAEDTAVYYCAR | DTA-----------TPFDY | WGQGTLVTVSS | 151 |
| Ab16 | SS-12427_HC | 48A9 | RFTISRDNSKNTLYLQMNSLRAEDTAVYYCAR | DLRYNW--------NDGGVDY | WGQGTLVTVSS | 152 |
| Ab17 | SS-10943_HC | 5H7 | RVTISIDTSKNHFSLKLSSVTAADTAVYYCAR | DLFYDS--------SGPRGFDP | WGQGTLVTVSS | 153 |

FIG. 9B

Engineered Variable Region Protein Alignment

| ID No. | Ref. No. | Antibody | FR1 | CDR1 | FR2 | CDR2 |
|---|---|---|---|---|---|---|
| KAPPA VARIABLE | | | | | | |
| Ab22 | SS-12562_LC | 49D9v1 | DIQMTQSPSSLSASVGDRVTITC | RAS--QGIR------NDLG | WYQQKPGKAPKRLIY | A--------ASSLQS |
| Ab39 | SS-13810_LC | 7A10v1 | DIQMTQSPSSLSASVGDRVTITC | RAS--QGIR------NDLG | WYQQKPGKAPKRLIY | A--------ASSLQS |
| Ab40 | SS-16938_LC | 7A10v2 | DIQMTQSPSSLSASVGDRVTITC | RAS--QGIR------NDLG | WYQQKPGKAPKLLIY | A--------ASSLQS |
| Ab41 | SS-16939_LC | 7A10v3 | DIQMTQSPSSLSASVGDRVTITC | RAS--QGIR------NDLG | WYQQKPGKAPKRLIY | A--------ASSLQS |
| Ab42 | SS-16940_LC | 7A10v4 | DIQMTQSPSSLSASVGDRVTITC | RAS--QGIR------NDLG | WYQQKPGKAPKRLIY | A--------ASSLQS |
| Ab43 | SS-16941_LC | 7A10v5 | DIQMTQSPSSLSASVGDRVTITC | RAS--QGIR------NDLG | WYQQKPGKAPKRLIY | A--------ASSLQS |
| Ab44 | SS-16943_LC | 9H6v1 | DIQMTQSPSSLSASVGDRVTITC | RAS--QGIR------NDLG | WYQQKRGKAPKRLIY | A--------TSSLQS |
| Ab45 | SS-16944_LC | 9H6v2 | DIQMTQSPSSLSASVGDRVTITC | RAS--QGIR------NDLG | WYQQKPGKAPKLLIY | A--------TSSLQS |
| Ab46 | SS-13806_LC | 9H6v3 | DIQMTQSPSSLSASVGDRVTITC | RAS--QGIR------NDLG | WYQQKPGKAPKRLIY | A--------TSSLQS |
| Ab47 | SS-16945_LC | 9H6v4 | DIQMTQSPSSLSASVGDRVTITC | RAS--QGIR------NDLG | WYQQKPGKAPKRLIY | A--------TSSLQS |
| Ab48 | SS-16946_LC | 9H6v5 | DIQMTQSPSSLSASVGDRVTITC | RAS--QGIR------NDLG | WYQQKPGKAPKLLIY | A--------TSSLQS |
| Ab49 | SS-16947_LC | 9H6v6 | DIQMTQSPSSLSASVGDRVTITC | RAS--QGIR------NDLG | WYQQKPGKAPKLLIY | A--------TSSLQS |
| Ab50 | SS-16948_LC | 33C9v1 | DIQMTQSPSSLSASVGDRVTITC | RAS--QGIR------NDLG | WYQQKPGKAPKLLIY | A--------ASSLQS |
| Ab51 | SS-13808_LC | 33C9v2 | DIQMTQSPSSLSASVGDRVTITC | RAS--QGIR------NDLG | WYQQRPGKAPKRLIY | D--------ASSLQS |
| Ab52 | SS-16949_LC | 33C9v3 | DIQMTQSPSSLSASVGDRVTITC | RAS--QGIR------NDLG | WYQQKPGKAPKRLIY | D--------ASSLQS |
| Ab53 | SS-16950_LC | 33C9v4 | DIQMTQSPSSLSASVGDRVTITC | RAS--QGIR------NDLG | WYQQKPGKAPKRLIY | D--------ASSLQS |
| Ab54 | SS-16951_LC | 33C9v5 | DIQMTQSPSSLSASVGDRVTITC | RAS--QGIR------NDLG | WYQQKPGKAPKLLIY | D--------ASSLQS |
| Ab55 | SS-16952_LC | 41G5v1 | DIQMTQSPSSLSASVGDRVTITC | RAS--QGIR------NDLG | WYQQKPGKAPKLLIY | A--------ASSLQS |
| Ab56 | SS-16953_LC | 41G5v2 | DIQMTQSPSSLSASVGDRVTVTC | RAS--QGIR------NDLG | WYQQKPGKAPKRLIY | A--------ASSLQS |
| Ab57 | SS-16953_LC | 41G5v3 | DIQMTQSPSSLSASVGDRVTITC | RAS--QGIR------NDLG | WYQQKPGKAPKRLIY | A--------ASSLQS |
| Ab58 | SS-16954_LC | 41G5v4 | DIQMTQSPSSLSASVGDRVTVTC | RAS--QGIR------NDLG | WYQQKPGKAPKLLIY | A--------ASSLQS |
| Ab59 | SS-16955_LC | 41G5v5 | DIQMTQSPSSLSASVGDRVTVTC | RAS--QGIR------NDLG | WYQQKPGKAPKLLIY | A--------ASSLQS |
| Ab24 | SS-12513_LC | 48A9v1 | DIQMTQSPSSLSASVGDRVTITC | RAS--QSIS------SYLH | WYKQKPGKAPKLLIY | G--------ASRLQS |
| Ab25 | SS-12612_LC | 5H7v1 | EIVLTQSPGTLSLSPGERATLSC | RAS--QTVSS-----NVLA | WYQQKPGQAPRLLIY | G--------SSTRAT |
| Ab26 | SS-13807_LC | 5H7v2 | EIVLTQSPGTLSLSPGERATLSC | RAS--QTVSS-----NVLA | WYQQKPGQAPRLLIY | G--------SSTRAT |
| Ab27 | SS-16913_LC | 5H7v3 | EIVLTQSPGTLSLSPGERATLSC | RAS--QTVSS-----NVLA | WYQQKPGQAPRLLIY | G--------SSTRAT |
| Ab28 | SS-16915_LC | 5H7v5 | EIVLTQSPGTLSLSPGERATLSC | RAS--QTVSS-----NVLA | WYQQKPGQAPRLLIY | G--------SSTRAT |
| Ab29 | SS-16917_LC | 5H7v7 | EIVLTQSPGTLSLSPGERATLSC | RAS--QTVSS-----NVLA | WYQQKPGQAPRLLIY | G--------SSTRAT |
| Ab30 | SS-16921_LC | 5H7v9 | EIVLTQSPGTLSLSPGERATLSC | RAS--QTVSS-----NVLA | WYQQKPGQAPRLLIY | G--------SSTRAT |
| Ab31 | SS-16919_LC | 5H7v10 | EIVLTQSPGTLSLSPGERATLSC | RAS--QTVSS-----NVLA | WYQQKPGQAPRLLIY | G--------SSTRAT |
| Ab32 | SS-16920_LC | 5H7v11 | EIVLTQSPGTLSLSPGERATLSC | RAS--QTVSS-----NVLA | WYQQKPGQAPRLLIY | G--------SSTRAT |
| Ab33 | SS-16923_LC | 5H7v13 | EIVLTQSPGTLSLSPGERATLSC | RAS--QTVSS-----NVLA | WYQQKPGQAPRLLIY | G--------SSTRAT |
| Ab34 | SS-16924_LC | 5H7v14 | EIVLTQSPGTLSLSPGERATLSC | RAS--QTVSS-----NVLA | WYQQKPGQAPRLLIY | G--------SSTRAT |
| Ab35 | SS-16927_LC | 5H7v17 | EIVLTQSPGTLSLSPGERATLSC | RAS--QTVSS-----NVLA | WYQQKPGQAPRLLIY | G--------SSTRAT |
| Ab36 | SS-16928_LC | 5H7v18 | EIVLTQSPGTLSLSPGERATLSC | RAS--QTVSS-----NVLA | WYQQKPGQAPRLLIY | G--------SSTRAT |
| Ab37 | SS-16929_LC | 5H7v19 | EIVLTQSPGTLSLSPGERATLSC | RAS--QTVSS-----NVLA | WYQQKPGQAPRLLIY | G--------SSTRAT |
| Ab38 | SS-16932_LC | 5H7v22 | EIVLTQSPGTLSLSPGERATLSC | RAS--QTVSS-----NVLA | WYQQKPGQAPRLLIY | G--------SSTRAT |
| LAMBDA VARIABLE | | | | | | |
| Ab20 | SS-12514_LC | 44C1v1 | QSALTQP-ASVSGSPGQSITISC | TGTS-SDVGTY----NLVS | WYQQHPGKAPKLMIY | E--------VSKRPS |
| Ab21 | SS-12515_LC | 45A8v1 | QSALTQP-ASVSGSPGQSITISC | TGTS-SDVGTY----NLVS | WYQQHPGKAPKLMIY | E--------VSKRPS |
| Ab23 | SS-12516_LC | 49E2v1 | QSALTQP-ASVSGSPGQSITISC | TGTS-SDVGIY----NLVS | WYQQHPGKAPKLMIH | E--------VSKRPS |

FIG. 10A

Engineered Variable Region Protein Alignment

| ID No. | Ref. No. | Antibody | FR3 | CDR3 | | FR4 | SEQ ID |
|---|---|---|---|---|---|---|---|
| KAPPA VARIABLE | | | | | | | |
| Ab22 | SS-12562_LC | 49D9v1 | GVPSRFSGSGSG--TEFTLTITSSLQPEDFATYYC | LQLNS------------- | -YPWT | FGQGTKVEIKR | 238 |
| Ab39 | SS-13810_LC | 7A10v1 | GVPSRFSGSGSG--TEFTLTITSSLQPEDFATYYC | QQHNS------------- | -YPWT | FGQGTKVEIKR | 255 |
| Ab40 | SS-16938_LC | 7A10v2 | GVPSRFSGSGSG--TEFTLTITSSLQPEDFATYYC | QQHNS------------- | -YPWT | FGQGTKVEIKR | 256 |
| Ab41 | SS-16939_LC | 7A10v3 | GVPSRFSGSGSG--TEFTLTITSSLQPEDFATYYC | QQHNS------------- | -YPWT | FGQGTKVEIKR | 257 |
| Ab42 | SS-16940_LC | 7A10v4 | GVPSRFSGSGSG--TEFTLTITSSLQPEDFATYYC | QQHNS------------- | -YPWT | FGQGTKVEIKR | 258 |
| Ab43 | SS-16941_LC | 7A10v5 | GVPSRFSGSGSG--TEFTLTITSSLQPEDFATYYC | QQHNS------------- | -YPWT | FGQGTKVEIKR | 259 |
| Ab44 | SS-16943_LC | 9H6v1 | GVPSRFSGSGSG--TEFTLTITSSLQPEDFATYYC | LQHNT------------- | -YPWT | FGQGTKVEIKR | 260 |
| Ab45 | SS-16944_LC | 9H6v2 | GVPSRFSGSGSG--TEFTLTITSSLQPEDFATYYC | LQHNT------------- | -YPWT | FGQGTKVEIKR | 261 |
| Ab46 | SS-13806_LC | 9H6v3 | GVPSRFSGSGSG--TEFTLTITSSLQPEDFATYYC | LQHNT------------- | -YPWT | FGQGTKVEIKR | 262 |
| Ab47 | SS-16945_LC | 9H6v4 | GVPSRFSGSGSG--TEFTLTITSSLQPEDFATYYC | LQHNT------------- | -YPWT | FGQGTKVEIKR | 263 |
| Ab48 | SS-16946_LC | 9H6v5 | GVPSRFSGSGSG--TEFTLTITSSLQPEDFATYYC | LQHNT------------- | -YPWT | FGQGTKVEIKR | 264 |
| Ab49 | SS-16947_LC | 9H6v6 | GVPSRFSGSGSG--TEFTLTITSSLQPEDFATYYC | LQHNT------------- | -YPWT | FGQGTKVEIKR | 265 |
| Ab50 | SS-16948_LC | 33C9v1 | GVPSRFSGSGSG--TEFTLTITSSLQPEDFATYYC | LQHHS------------- | -YPWT | FGQGTKVEIKR | 266 |
| Ab51 | SS-13808_LC | 33C9v2 | GVPSRFSGSGSG--TEFTLTITSSLQPEDFATYYC | LQHHS------------- | -YPWT | FGQGTKVEIKR | 267 |
| Ab52 | SS-16949_LC | 33C9v3 | GVPSRFSGSGSG--TEFTLTITSSLQPEDFATYYC | LQHHS------------- | -YPWT | FGQGTKVEIKR | 268 |
| Ab53 | SS-16950_LC | 33C9v4 | GVPSRFSGSGSG--TEFTLTITSSLQPEDFATYYC | LQHHS------------- | -YPWT | FGQGTKVEIKR | 269 |
| Ab54 | SS-16951_LC | 33C9v5 | GVPSRFSGSGSG--TEFTLTITSSLQPEDFATYYC | LQHHS------------- | -YPWT | FGQGTKVEIKR | 270 |
| Ab55 | SS-16952_LC | 41G5v1 | GVPSRFSGSGSG--TEFTLTITSSLQPEDFATYYC | LQHNN------------- | -YPWT | FGQGTKVDIKR | 271 |
| Ab56 | SS-13809_LC | 41G5v2 | GVPSRFSGSGSG--TEFTLTITSSLQPEDFATYYC | LQHNN------------- | -YPWT | FGQGTKVDIKR | 272 |
| Ab57 | SS-16953_LC | 41G5v3 | GVPSRFSGSGSG--TEFTLTITSSLQPEDFATYYC | LQHNN------------- | -YPWT | FGQGTKVDIKR | 273 |
| Ab58 | SS-16954_LC | 41G5v4 | GVPSRFSGSGSG--TEFTLTITSSLQPEDFATYYC | LQHNN------------- | -YPWT | FGQGTKVDIKR | 274 |
| Ab59 | SS-16955_LC | 41G5v5 | GVPSRFSGSGSG--TEFTLTITSSLQPEDFATYYC | LQHNN------------- | -YPWT | FGQGTKVDIKR | 275 |
| Ab24 | SS-12513_LC | 48A9v1 | GVPSRFSGSGSG--TDFTLTITSSLQPEDFATYYC | QQSSS------------- | TPLT  | FGQGTKVEIKR | 240 |
| Ab25 | SS-16912_LC | 5H7v1 | GIPDRFSGSGSG--TDFTLTITSRLEPEDFAVYYC | QQYDS------------- | SPWT  | FGQGTKVEIKR | 241 |
| Ab26 | SS-13807_LC | 5H7v2 | GIPDRFSGSGSG--TDFTLTITSRLEPEDFAVYYC | QQYDS------------- | SPWT  | FGQGTKVEIKR | 242 |
| Ab27 | SS-16913_LC | 5H7v3 | GIPDRFSGSGSG--TDFTLTITSRLEPEDFAVYYC | QQYDS------------- | SPWT  | FGQGTKVEIKR | 243 |
| Ab28 | SS-16915_LC | 5H7v5 | GIPDRFSGSGSG--TDFTLTITSRLEPEDFAVYYC | QQYES------------- | SPWT  | FGQGTKVEIKR | 244 |
| Ab29 | SS-16917_LC | 5H7v7 | GIPDRFSGSGSG--TDFTLTITSRLEPEDFAVYYC | QQYDS------------- | SPWT  | FGQGTKVEIKR | 245 |
| Ab30 | SS-16921_LC | 5H7v9 | GIPDRFSGSGSG--TDFTLTITSRLEPEDFAVYYC | QQYDS------------- | SPWT  | FGQGTKVEIKR | 246 |
| Ab31 | SS-16919_LC | 5H7v10 | GIPDRFSGSGSG--TDFTLTITSRLEPEDFAVYYC | QQYES------------- | SPWT  | FGQGTKVEIKR | 247 |
| Ab32 | SS-16920_LC | 5H7v11 | GIPDRFSGSGSG--TDFTLTITSRLEPEDFAVYYC | QQYDT------------- | SPWT  | FGQGTKVEIKR | 248 |
| Ab33 | SS-16923_LC | 5H7v13 | GIPDRFSGSGSG--TDFTLTITSRLEPEDFAVYYC | QQYES------------- | SPWT  | FGQGTKVEIKR | 249 |
| Ab34 | SS-16924_LC | 5H7v14 | GIPDRFSGSGSG--TDFTLTITSRLEPEDFAVYYC | QQYDS------------- | SPWT  | FGQGTKVEIKR | 250 |
| Ab35 | SS-16927_LC | 5H7v17 | GIPDRFSGSGSG--TDFTLTITSRLEPEDFAVYYC | QQYDT------------- | SPWT  | FGQGTKVEIKR | 251 |
| Ab36 | SS-16928_LC | 5H7v18 | GIPDRFSGSGSG--TDFTLTITSRLEPEDFAVYYC | QQYDT------------- | SPWT  | FGQGTKVEIKR | 252 |
| Ab37 | SS-16929_LC | 5H7v19 | GIPDRFSGSGSG--TDFTLTITSRLEPEDFAVYYC | QQYDT------------- | SPWT  | FGQGTKVEIKR | 253 |
| Ab38 | SS-16932_LC | 5H7v22 | GIPDRFSGSGSG--TDFTLTITSRLEPEDFAVYYC | QQYES------------- | SPWT  | FGQGTKVEIKR | 254 |
| LAMBDA VARIABLE | | | | | | | |
| Ab20 | SS-12514_LC | 44C1v1 | GVSNRFSGSKSG--NTASLTISGLQAEDEADYC | ASYAGF------------ | STWV  | FGGGTKLTVLG | 236 |
| Ab21 | SS-12515_LC | 45A8v1 | GISNRFSGSKSG--NTASLTISGLQAEDEADYC | ASYAGY------------ | STWV  | FGGGTKLTVLR | 237 |
| Ab23 | SS-12516_LC | 49E2v1 | GVSNRFSGSKSG--NTASLTISGLQAEDEADYC | ASYAGI------------ | STWV  | FGGGTKLTVLG | 239 |

FIG. 10B

Engineered Variable Region Protein Alignment

| ID No. | HEAVY VARIABLE Ref. No. | Antibody | FR1 | CDR1 | FR2 | CDR2 |
|---|---|---|---|---|---|---|
| Ab20 | SS-12514_HC | 44C1v1 | QVQLVES-GGGVVQPGRSLRLSCAASG-FTLS | S-----YGMH | WVRQAPGKGLEWVA | VIWYD---GSNKYYADSVKG |
| Ab21 | SS-12515_HC | 45A8v1 | QVQLVES-GGGVVQPGRSLRLSCAASG-FTFS | S-----YGMH | WVRQAPGKGLEWVA | VIWHD---GSNKYYADSVKG |
| Ab22 | SS-12562_HC | 49D9v1 | QMQLVES-GGGVVQPGGSLRLSCAASG-FTFS | S-----YGMH | WVRQAPGKGLEWVA | VIWYA---GSNKYYADSVKG |
| Ab39 | SS-13810_HC | 7A10v1 | QVQLVES-GGGVVQPGRSLRLSCAASG-FTFS | S-----YGMH | WVRQAPGKGLEWVA | VIWYV---GSNKYYADSVKG |
| Ab40 | SS-16938_HC | 7A10v2 | QVQLVES-GGGVVQPGRSLRLSCAASG-FTFS | S-----YGMH | WVRQAPGKGLEWVA | VIWYV---GSNKYYADSVKG |
| Ab41 | SS-16939_HC | 7A10v3 | QVQLVES-GGGVVQPGRSLRLSCAASG-FTFS | S-----YGMH | WVRQAPGKGLEWMA | VIWYV---GSNKYYAESVKG |
| Ab42 | SS-16940_HC | 7A10v4 | QVQLVES-GGGVVQPGRSLRLSCAASG-FTFS | S-----YGMH | WVRQAPGKGLEWVA | VIWYV---GSNKYYADTVKG |
| Ab43 | SS-16941_HC | 7A10v5 | QVQLVES-GGGVVQPGRSLRLSCAASG-FTFS | S-----YGMH | WVRQAPGKGLEWMA | VIWYV---GSNKYYAESVKG |
| Ab44 | SS-16943_HC | 9H6v1 | QVQLVES-GGGVVQPGRSLRLSCVAASG-FTFS | S-----YGMH | WIRQAPGKGLEWVA | VIWYE---GSNKYYADSVKG |
| Ab45 | SS-16944_HC | 9H6v2 | QVQLVES-GGGVVQPGRSLRLSCVASG-FTFS | S-----YGMH | WIRQAPGKGLEWVA | VIWYE---GSNKYYADSVKG |
| Ab46 | SS-13806_HC | 9H6v3 | QVQLVES-GGGVVQPGRSLRLSCVASG-FTFS | S-----YGMH | WIRQAPGKGLEWVA | VIWYE---GSNKYYAESVKG |
| Ab47 | SS-16945_HC | 9H6v4 | QVQLVES-GGGVVQPGRSLRLSCVASG-FTFS | S-----YGMH | WIRQAPGKGLEWVA | VIWYE---GSNKYYADTVKG |
| Ab48 | SS-16946_HC | 9H6v5 | QVQLVES-GGGVVQPGRSLRLSCAASG-FTFS | S-----YGMH | WIRQAPGKGLEWVA | VIWYE---GSNKYYAESVKG |
| Ab49 | SS-16947_HC | 9H6v6 | QVQLVES-GGGVVQPGRSLRLSCAASG-FTFS | S-----YGMH | WIRQAPGKGLEWVA | VIWYE---GSNKYYADTVKG |
| Ab50 | SS-16948_HC | 33C9v1 | QVQLVES-GGGVVQPGRSLRLSCAASG-FTFS | S-----YGMH | WVRQAPGKGLEWVS | VIWYE---GSNKYYADSVKG |
| Ab51 | SS-16952_HC | 33C9v2 | QVQVVES-GGGVVQPGRSLRLSCAASG-FTFS | S-----YGMH | WVRQAPGKGLEWVS | VIWYE---GSNKYYAESVKG |
| Ab52 | SS-16949_HC | 33C9v3 | QVQVVES-GGGVVQPGRSLRLSCAASG-FTFS | S-----YGMH | WVRQAPGKGLEWVS | VIWYE---GSNKYYADTVKG |
| Ab53 | SS-16950_HC | 33C9v4 | QVQVVES-GGGVVQPGRSLRLSCAASG-FTFS | S-----YGMH | WVRQAPGKGLEWVS | VIWYE---GSNKYYAESVKG |
| Ab54 | SS-16951_HC | 33C9v5 | QVQVVES-GGGVVQPGRSLRLSCAASG-FTFS | S-----YGMH | WVRQAPGKGLEWVS | VIWYE---GSNKYYADTVKG |
| Ab55 | SS-16952_HC | 41G5v1 | QVQLVES-GGGVVQPGRSLRLSCAASG-FTFS | S-----YGMH | WVKQAPGKGLEWVA | VIWYP---GSNKYYADSVKG |
| Ab56 | SS-13809_HC | 41G5v2 | QVQLVES-GGGVVQPGRSLRLSCAASG-FTFS | S-----YGMH | WVRQAPGKGLEWVA | VIWYP---GSNKYYAESVKG |
| Ab57 | SS-16953_HC | 41G5v3 | QVQLVES-GGGVVQPGRSLRLSCAASG-FTFS | S-----YGMH | WVRQAPGKGLEWVA | VIWYP---GSNKYYADTVKG |
| Ab58 | SS-16954_HC | 41G5v4 | QVQLVES-GGGVVQPGRSLPLSCAASG-FTFS | S-----YGMH | WVRQAPGKGLEWVA | VIWYP---GSNKYYAESVKG |
| Ab59 | SS-16955_HC | 41G5v5 | QVQLVES-GGGVVQPGRSLRLSCAASG-FTFS | S-----YGMH | WVRQAPGKGLEWVA | VIWYP---GSNKYYADTVKG |
| Ab23 | SS-12516_HC | 49E2v1 | QVQLVES-GGGVVQPGRSLRLSCAASG-FTFS | S-----YGMH | WVRQAPGKGLEWVA | VIWSD---GNNKYYEDSVKG |
| Ab24 | SS-12513_HC | 48A9v1 | QVQLVES-GGGVVQPGRSLRLSCAASG-FTFS | S-----YGMH | WVRQAPGKGLEWVA | VISYD---GSNKYYADSVKG |
| Ab25 | SS-16912_HC | 5H7v1 | QVQLQES-GPGLVKPSETLSLTCTVSG-GSIS | SG----GYFWS | WIRQPPGKGLEWIG | YIYY-----SGTTYYNPSLKS |
| Ab28 | SS-16915_HC | 5H7v5 | QVQLQES-GPGLVKPSETLSLTCTVSG-GSIS | SG----GYFWS | WIRQPPGKGLEWIG | YIYY-----SGTTYYNPSLKS |
| Ab26 | SS-13807_HC | 5H7v2 | QVQLQES-GPGLVKPSETLSLTCTVSG-GSIS | SG----GYFWS | WIRQPPGKGLEWIG | YIYY-----SGTTYYNPSLKS |
| Ab27 | SS-16913_HC | 5H7v3 | QVQLQES-GPGLVKPSETLSLTCTVSG-GSIS | SG----GYFWS | WIRQPPGKGLEWIG | YIYY-----SGTTYYNPSLKS |
| Ab29 | SS-16917_HC | 5H7v7 | QVQLQES-GPGLVKPSETLSLTCTVSG-GSIS | SG----GYFWS | WIRQPPGKGLEWIG | YIYY-----SGTTYYNPSLKS |
| Ab30 | SS-16921_HC | 5H7v10 | QVQLQES-GPGLVKPSETLSLTCTVSG-GSIS | SG----GYFWS | WIRQPPGKGLEWIG | YIYY-----SGTTYYNPSLKS |
| Ab31 | SS-16919_HC | 5H7v11 | QVQLQES-GPGLVKPSETLSLTCTVSG-GSIS | SG----GYFWS | WIRQPPGKGLEWIG | YIYY-----SGTTYYNPSLKS |
| Ab32 | SS-16920_HC | 5H7v13 | QVQLQES-GPGLVKPSETLSLTCTVSG-GSIS | SG----GYFWS | WIRQPPGKGLEWIG | YIYY-----SGTTYYNPSLKS |
| Ab33 | SS-16923_HC | 5H7v14 | QVQLQES-GPGLVKPSETLSLTCTVSG-GSIS | SG----GYFWS | WIRQPPGKGLEWIG | YIYY-----SGTTYYNPSLKS |
| Ab34 | SS-16924_HC | 5H7v17 | QVQLQES-GPGLVKPSETLSLTCTVSG-GSIS | SG----GYFWS | WIRQPPGKGLEWIG | YIYY-----SGTTYYNPSLKS |
| Ab35 | SS-16927_HC | 5H7v18 | QVQLQES-GPGLVKPSETLSLTCTVSG-GSIS | SG----GYFWS | WIRQPPGKGLEWIG | YIYY-----SGTTYYNPSLKS |
| Ab36 | SS-16928_HC | 5H7v19 | QVQLQES-GPGLVKPSETLSLTCTVSG-GSIS | SG----GYFWS | WIRQPPGKGLEWIG | YIYY-----SGTTYYNPSLKS |
| Ab38 | SS-16932_HC | 5H7v22 | QVQLQES-GPGLVKPSETLSLTCTVSG-GSIS | SG----GYFWS | WIRQPPGKGLEWIG | YIYY-----SGTTYYNPSLKS |
| Ab37 | SS-16929_HC | 5H7v19 | QVQLQES-GPGLVKPSETLSLTCTVSG-GSIS | SG----GYFWS | WIRQPPGKGLEWIG | YIYY-----SGTTYYNPSLKS |

FIG. 11A

Engineered Variable Region Protein Alignment

| Ab No. | Ref. No. | Antibody | FR3 | CDR3 | | FR4 | SEQ ID |
|---|---|---|---|---|---|---|---|
| HEAVY_VARIABLE | | | | | | | |
| Ab20 | SS-12514_HC | 44C1v1 | RFTISRDNSKNTLYLQMNSLRAEDTAVYYCAR | RGTVT------------- | -TPDFDY | WGQGTLVTVSS | 276 |
| Ab21 | SS-12515_HC | 45A8v1 | RFTISKDNSKNTLYLQMNSLRAEDTAVYYCAR | EYG-------------- | ---GMFDY | WGQGTLVTVSS | 277 |
| Ab22 | SS-12562_HC | 49D9v1 | RFTISRDNSKNTLYLQMNSLRAEDTAVYYCAR | ---------------- | -YYYGMDV | WGQGTTVTVSS | 278 |
| Ab39 | SS-13810_HC | 7A10v1 | RFTISRDNSKNTLYLQMNSLRAEDTAVYYCAR | GGELGR----------- | -DYYSGMDV | WGQGTTVTVSS | 295 |
| Ab40 | SS-16938_HC | 7A10v2 | RFTISRDNSKNTLYLQMNSLRAEDTAVYYCAR | GGELGR----------- | -DYYSGMDV | WGQGTTVTVSS | 296 |
| Ab41 | SS-16939_HC | 7A10v3 | RFTISRDNSKNTLYLQMNSLRAEDTAVYYCAR | GGELGR----------- | -DYYSGMDV | WGQGTTVTVSS | 297 |
| Ab42 | SS-16940_HC | 7A10v4 | RFTISRDNSKNTLYLQMNSLRAEDTAVYYCAR | GGELGR----------- | -DYYSGMDV | WGQGTTVTVSS | 298 |
| Ab43 | SS-16941_HC | 7A10v5 | RFTISRDNSKNTLYLQMNSLRAEDTAVYYCAR | GGELGR----------- | -DYYSGMDV | WGQGTTVTVSS | 299 |
| Ab44 | SS-16943_HC | 9H6v1 | RFTISRDNSKNTLYLQMNSLRAEDTAVYYCAR | GGRLGK----------- | -DYYSGMDV | WGQGTTVTVSS | 300 |
| Ab45 | SS-16944_HC | 9H6v2 | RFTISRDNSKNTLYLQMNSLRAEDTAVYYCAR | GGRLGK----------- | -DYYSGMDV | WGQGTTVTVSS | 301 |
| Ab46 | SS-13806_HC | 9H6v3 | RFTISRDNSKNTLYLQMNSLRAEDTAVYYCAR | GGRLGK----------- | -DYYSGMDV | WGQGTTVTVSS | 302 |
| Ab47 | SS-16945_HC | 9H6v4 | RFTISRDNSKNTLYLQMNSLRAEDTAVYYCAR | GGRLGK----------- | -DYYSGMDV | WGQGTTVTVSS | 303 |
| Ab48 | SS-16946_HC | 9H6v5 | RFTISRDNSKNTLYLQMNSLRAEDTAVYYCAR | GGRLGK----------- | -DYYSGMDV | WGQGTTVTVSS | 304 |
| Ab49 | SS-16947_HC | 9H6v6 | RFTISRDNSKNTLYLQMNSLRAEDTAVYYCAR | GGRLGK----------- | -DYYSGMDV | WGQGTTVTVSS | 305 |
| Ab50 | SS-16948_HC | 33C9v1 | RFTISRDNSKNTLYLQMNSLRAEDTAVYYCAR | GGLLGY----------- | -YYYYGMDV | WGQGTTVTVSS | 306 |
| Ab51 | SS-13808_HC | 33C9v2 | RFTISRDNSKNTLYLQMNSLRAEDTAVYYCAR | GGLLGY----------- | -YYYYGMDV | WGQGTTVTVSS | 307 |
| Ab52 | SS-16949_HC | 33C9v3 | RFTISRDNSKNTLYLQMNSLRAEDTAVYYCAR | GGLLGY----------- | -YYYYGMDV | WGQGTTVTVSS | 308 |
| Ab53 | SS-16950_HC | 33C9v4 | RFTISRDNSKNTLFLQMNSLRAEDTAVYYCAR | GGLLGY----------- | -YYYYGMDV | WGQGTTVTVSS | 309 |
| Ab54 | SS-16951_HC | 33C9v5 | RFTISRDNSKNTLYLQMNSLRAEDTAVYYCAR | GGLLGY----------- | -YYYYGMDV | WGQGTTVTVSS | 310 |
| Ab55 | SS-16952_HC | 41G5v1 | RFTISRDSSKNTLYLQMNSLRAEDTAVYYCAR | GGELGR----------- | -YYYYGMDV | WGQGTTVTVSS | 311 |
| Ab56 | SS-13809_HC | 41G5v2 | RFTISRDNSKNTLYLQMNSLRAEDTAVYYCAR | GGELGR----------- | -YYYYGMDV | WGQGTTVTVSS | 312 |
| Ab57 | SS-16953_HC | 41G5v3 | RFTISRDNSKNTLYLQMNSLRAEDTAVYYCAR | GGELGR----------- | -YYYYGMDV | WGQGTTVTVSS | 313 |
| Ab58 | SS-16954_HC | 41G5v4 | RFTISRDNSKNTLYLQMNSLRAEDTAVYYCAR | GGELGR----------- | -YYYYGMDV | WGQGTTVTVSS | 314 |
| Ab59 | SS-16955_HC | 41G5v5 | RFTISRDNSKNTLYLQMNSLRAEDTAVYYCAR | GGELGR----------- | -YYYYGMDV | WGQGTTVTVSS | 315 |
| Ab23 | SS-12516_HC | 49F2v1 | RFTISRDNSKNTLFLQMNSLRAEDTAVYYCAR | DTA-------------- | --TPPDY | WGQGTLVTVSS | 279 |
| Ab24 | SS-12513_HC | 48A9v1 | RFTISRDNSKNTLYLQMNSLRAEDTAVYYCAR | DLRYNW----------- | -NDGGVDY | WGQGTLVTVSS | 280 |
| Ab25 | SS-16912_HC | 5H7v1 | RVTIISIDTSKNQFSLKLKLSSVTAADTAVYYCAR | DLFYYES---------- | -SGPRGFDP | WGQGTLVTVSS | 281 |
| Ab28 | SS-16915_HC | 5H7v5 | RVTIISIDTSKNQFSLKLKLSSVTAADTAVYYCAR | DLFYYES---------- | -SGPRGFEP | WGQGTLVTVSS | 284 |
| Ab26 | SS-13807_HC | 5H7v2 | RVTIISIDTSKNQFSLKLKLSSVTAADTAVYYCAR | DLFYYDT---------- | -SGPRGFDP | WGQGTLVTVSS | 282 |
| Ab27 | SS-16913_HC | 5H7v3 | RVTIISIDTSKNQFSLKLKLSSVTAADTAVYYCAR | DLFYYDS---------- | -SGPRGFEP | WGQGTLVTVSS | 283 |
| Ab29 | SS-16917_HC | 5H7v7 | RVTIISIDTSKNQFSLKLKLSSVTAADTAVYYCAR | DLFYYDT---------- | -SGERGFEP | WGQGTLVTVSS | 285 |
| Ab30 | SS-16921_HC | 5H7v9 | RVTIISIDTSKNQFSLKLKLSSVTAADTAVYYCAR | DLFYYDS---------- | -SGPRGFDP | WGQGTLVTVSS | 286 |
| Ab31 | SS-16919_HC | 5H7v10 | RVTIISIDTSKNQFSLKLKLSSVTAADTAVYYCAR | DLFYYDS---------- | -SGPRGFDP | WGQGTLVTVSS | 287 |
| Ab32 | SS-16920_HC | 5H7v11 | RVTIISIDTSKNQFSLKLKLSSVTAADTAVYYCAR | DLFYYDS---------- | -SGPRGFDP | WGQGTLVTVSS | 288 |
| Ab33 | SS-16923_HC | 5H7v13 | RVTIISIDTSKNQFSLKLKLSSVTAADTAVYYCAR | DLFYYDT---------- | -SGPRGFDP | WGQGTLVTVSS | 289 |
| Ab34 | SS-16924_HC | 5H7v14 | RVTIISIDTSKNQFSLKLKLSSVTAADTAVYYCAR | DLFYYDS---------- | -SGPRGFEP | WGQGTLVTVSS | 290 |
| Ab35 | SS-16927_HC | 5H7v17 | RVTIISIDTSKNQFSLKLKLSSVTAADTAVYYCAR | DLFYYDT---------- | -SGPRGFDP | WGQGTLVTVSS | 291 |
| Ab36 | SS-16928_HC | 5H7v18 | RVTIISIDTSKNQFSLKLKLSSVTAADTAVYYCAR | DLFYYDS---------- | -SGPRGFEP | WGQGTLVTVSS | 292 |
| Ab38 | SS-16932_HC | 5H7v22 | RVTIISIDTSKNQFSLKLKLSSVTAADTAVYYCAR | DLFYYDT---------- | -SGPRGFEP | WGQGTLVTVSS | 294 |
| Ab37 | SS-16929_HC | 5H7v19 | RVTIISIDTSKNQFSLKLKLSSVTAADTAVYYCAR | DLFYYDS---------- | -SGPRGFDY | WGQGTLVTVSS | 293 |

FIG. 11B

GITR ANTIGEN BINDING PROTEINS AND METHODS OF USE THEREOF

CROSS-REFERENCE TO RELATED APPLICATIONS

This application claims the benefit of U.S. Provisional Application No. 61/872,125, filed Aug. 30, 2013, and U.S. Provisional Application Ser. No. 62/031,036, filed Jul. 30, 2014, both of which are hereby incorporated by reference in their entirety for all purposes.

SEQUENCE LISTING

The instant application contains a sequence listing which has been submitted electronically in ASCII format and is hereby incorporated by reference in its entirety. Said ASCII copy, created on Aug. 14, 2014, is named A-1856-US-NP_SeqList_ST25.txt and is 606,208 bytes in size.

BACKGROUND

Glucocorticoid-induced TNFR-related gene (GITR: TNFRSF18), sometimes also referred to as Activation-Inducible TNFR family member (AITR), is a receptor belonging to the TNF receptor superfamily (TNFRSF). It is activated by its cognate ligand, GITR ligand (GITRL, TNFSF18). GITR is a type I transmembrane protein that contains a cysteine-rich extracellular domain, which is characteristic of TNFR family members. The cytoplasmic domain of GITR, for instance, shares close homology with certain other TNFR family members, such as 4-1BB and CD27 (Nocentini, et al. (1997) Proc. Natl. Acad. Sci. 94:6216-6221).

Human GITR is expressed at low levels in responder resting T cells, with CD4+ cells exhibiting increased expression relative to CD8+ cells. GITR expression is up-regulated significantly for several days following T cell activation. GITR is constitutively expressed at high levels in regulatory T cells (Tregs), such as CD4+CD25+ or CD8+CD25+ cells, and is further up-regulated when these cells are activated (Nocentini and Riccardi (2005) E. J. Immunol. 35:1016-1022). GITR expression is not exclusively limited to T cells, however. Reports have also indicated that GITR is expressed on NK cells, macrophages, B cells, dendritic cells, mast cells and monocytes (Nocentini and Riccardi (2005) E. J. Immunol. 35:1016-1022).

GITRL is a type II transmembrane protein as is typical for most TNF ligand family members. Current research indicates that human GITRL typically exists as a trimer, although it can also be present as a monomer or assemble into other multimeric forms (Chattopadhyay, et al. (2007) Proc. Natl. Acad. Sci. 104:19452-19457; Zhou, et al. (2008) Proc. Natl. Acad. Sci. 105:635-640). There is some evidence suggesting that a soluble form of GITRL is also produced (Baltz, et al. (2008) Blood 112:3735-3743; Mahesh, et al. (2006) Eur. J. Immunol. 36: 2128-2138). GITRL is expressed primarily on antigen presenting cells (APC), including macrophages, B cells, dendritic cells and endothelial cells that can function as APC (Nocentini and Riccardi (2005) E. J. Immunol. 35:1016-1022; Agostini, et al. (2005) Infect. Immun. 73:7502-7508; and Nocentini, et al. (2007) E. J. Immunol. 37:1165-1169).

Binding of GITRL on APC to GITR on responder T cells triggers GITR signaling, which co-stimulates responder T cells and inhibits the suppressive activity of Treg cells. GITR signaling functions as a co-activating signal to both CD4+ and CD8+naïve T cells, thereby inducing or enhancing proliferation and effector function, particularly when T cell receptor (TCR) stimulation is suboptimal (Schaer, et al. (2012) Curr. Opin. Immunol. 24:217-224). More specifically, GITR can have several effects on effector T cells and regulatory T cells, including: co-stimulation and activation of effector T cells such that they are more resistant to inhibition, inhibiting regulatory T cells, decreasing the sensitivity of effector T cells to suppression by regulatory T cells and partial deletion of regulatory T cells in the circulation (Nocentini, et al. (2007) Eur. J. Immunol. 37:1165-1169).

Collectively, the foregoing activities, in particular the costimualtion of responder T cells and abrogation of the suppressor activity of regulatory T cells, means that GITR activation results in an enhanced immune response. Such activation has the potential to restore immune responses to infections and to tumors. Accordingly, molecules capable of activating GITR would be of value as immunostimulatory agents in settings in which it is desirable to trigger an enhanced immune response.

SUMMARY

Antigen binding proteins that bind GITR, such as human GITR, are described herein. The antigen binding proteins can be antibodies or fragments thereof or can be other types of molecular scaffolds into which one or more complementarity determining regions are embedded or inserted, provided that the molecule has the ability to bind GITR, such as human GITR. The antigen binding proteins are agonists of GITR and thus can induce or enhance GITR signaling. Given the role GITR plays in stimulating an immune response, the antigen binding proteins have utility in treating a variety of GITR-related diseases or disorders in which it is desirable to increase an immune response. For example, the antigen binding proteins can be used in a variety of immunotherapy applications, such as the treatment of a variety of cancers or infections.

In a first embodiment, an antigen binding protein is provided that comprises a) a CDRH3 and a CDRL3 of a heavy chain variable domain (VH) and a light chain variable domain (VL), respectively, wherein the VH and VL are part of the same antigen binding protein that is selected from any one of antigen binding proteins Ab1 to Ab59 inclusive;

b) a variant VH comprising a CDRH1, a CDRH2 and a CDRH3, wherein one or more of CDRH1, CDRH2 and CDRH3 differ in sequence relative to the corresponding CDRH1, CDRH2 and CDRH3 of the VH of any single antigen binding protein selected from the group of Ab1 to Ab59 inclusive, provided however that the sequence differences in the CDRH1, CDRH2 and CDRH3 of the variant VH relative to the corresponding CDRs of the VH sequence collectively total no more than 1, 2, 3, 4 or 5 amino acids;

c) a variant VL comprising a CDRL1, a CDRL2 and a CDRL3, wherein one or more of CDRL1, CDRL2 and CDRL3 differ in sequence relative to the corresponding CDRL1, CDRL2 and CDRL3 of the VL of any single antigen binding protein selected from the group of Ab1 to Ab59 inclusive, provided however that the sequence differences in the CDRL1, CDRL2 and CDRL3 of the variant VL relative to the corresponding CDRs of the VL sequence collectively total no more than 1, 2, 3, 4 or 5 amino acids;

d) the variant VH of b) and the variant VL of c), provided that the variant VH and the variant VL are, respectively, variants of the VH and VL of the same antigen binding protein;

e) a VH comprising a CDRH1, a CDRH2 and a CDRH3, wherein
CDRH1 comprises the sequence $X_1YGMX_2$ (SEQ ID NO:436), wherein X1 is S or N; and X2 is H or Y;
CDRH2 comprises the sequence VIWYX$_1$GSNKYYADSVX$_2$G (SEQ ID NO:437), wherein X1 is E, V, A, P; and X2 is K or R;
CDRH3 comprises the sequence GGX$_1$LX$_2$X$_3$X$_4$YYX$_5$GMDV (SEQ ID NO:438), wherein X1 is Q, L, E, or R; X2 is G, R, or S; X3 is K, Y, L, F, or R; and X4 is Y or D; and X5 is Y or S;

f) a VL comprising a CDRL1, a CDRL2 and a CDRL3, wherein
CDRL1 comprises the sequence RASQX$_1$IRNDLG (SEQ ID NO:439), wherein X1 is G or V;
CDRL2 comprises the sequence $X_1X_2SX_3LQS$ (SEQ ID NO:440), wherein X1 is A or D; X2 is A or T; and X3 is S or T;
CDRL3 comprises the sequence $X_1QX_2X_3X_4YPX_5T$ (SEQ ID NO:441), wherein X1 is L or Q; X2 is H or L; X3 is N or H; X4 is S, N or T, and X5 is W, L or I;

g) the VH of e) and the VL of f);

h) a CDRH1, a CDRH2 and a CDRH3, each from the same VH of an antigen binding protein of Ab1 to Ab59 inclusive;

i) the CDRL1, a CDRL2, and a CDRL3, each from the same VL of an antigen binding protein of Ab1 to Ab59 inclusive;

j) the CDRH1, CDRH2 and CDRH3 of h) and the CDRH1, CDRH2 and CDRH3 of i), wherein the VH and the VL are from the same antigen binding protein;

k) a VH that is at least 80%, 85%, 90%, 95%, 97% or 99% identical in amino acid sequence to the VH sequence of any one of antigen binding proteins Ab1 to Ab59 inclusive;

l) a VL that is at least 80%, 85%, 90%, 95%, 97% or 99% identical in amino acid sequence to the VL sequence of any one of antigen binding proteins Ab1 to Ab59 inclusive;

m) a VH of k) and the VL of l), wherein the VH and the VL are from the same antigen binding protein;

n) a VH comprising the amino acid sequence of the VH of any one of antigen binding proteins Ab1 to Ab59 inclusive;

o) a VL comprising the amino acid sequence of the VL of any one of antigen binding proteins Ab1 to Ab59 inclusive;

p) the VH of n) and the VL of o), wherein the VH and the VL are from the same antigen binding protein;

q) a full length heavy chain (HC) that is at least 90%, 95%, 97% or 99% identical in amino acid sequence to the full length heavy chain sequence of any one of antigen binding proteins Ab1 to AB59 inclusive;

r) a full length light chain (LC) that is at least 90%, 95%, 97% or 99% identical in amino acid sequence to the full length light chain sequence of any one of antigen binding proteins Ab1 to Ab59 inclusive;

s) a full length heavy chain of q) and a full length light chain of r), wherein the full length heavy chain and the full length light chain are from the same antigen binding protein;

t) a full length heavy chain comprising the amino acid sequence of the full length heavy chain of any one of the antigen binding proteins Ab1 to Ab59 inclusive;

u) a full length light chain comprising the amino acid sequence of the full length light chain of any one of the antigen binding proteins Ab1 to Ab59 inclusive; or v) a full length heavy chain of t) and a full length light chain of u), wherein the full length heavy chain and the full length light chain are from the same antigen binding protein.

In a second embodiment, the antigen binding protein comprises a CDRL1, a CDRL2, a CDRL3, a CDRH1, a CDRH2 and a CDRH3, and wherein one or more of CDRL1, CDRL2, CDRL3, CDRH1, CDRH2 and CDRH3 differ in sequence relative to the corresponding CDRL1, CDRL2, CDRL3, CDRH1, CDRH2 and CDRH3 of any single antibody selected from the group of Ab1 to Ab59 inclusive, provided however that the sequence differences in the CDRs collectively total no more than 1, 2, 3, 4, or 5 amino acids.

In a third embodiment, the antigen binding protein comprises a CDRL1, a CDRL2, a CDRL3, a CDRH1, a CDRH2 and a CDRH3, and wherein:

a) CDRL1 comprises SEQ ID NO:5, CDRL2 comprises SEQ ID NO:11, CDRL3 comprises SEQ ID NO:19, CDRH1 comprises SEQ ID NO:31, CDRH2 comprises SEQ ID NO:36 and CDRH3 comprises SEQ ID NO:47;

b) CDRL1 comprises SEQ ID NO:5 CDRL2 comprises SEQ ID NO:12, CDRL3 comprises SEQ ID NO:18, CDRH1 comprises SEQ ID NO:31, CDRH2 comprises SEQ ID NO:40 and CDRH3 comprises SEQ ID NO:52;

c) CDRL1 comprises SEQ ID NO:10, CDRL2 comprises SEQ ID NO:17, CDRL3 comprises SEQ ID NO:28, CDRH1 comprises SEQ ID NO:35, CDRH2 comprises SEQ ID NO:45 and CDRH3 comprises SEQ ID NO:62;

d) CDRL1 comprises SEQ ID NO:5, CDRL2 comprises SEQ ID NO:12, CDRL3 comprises SEQ ID NO:29, CDRH1 comprises SEQ ID NO:31, CDRH2 comprises SEQ ID NO:37 and CDRH3 comprises SEQ ID NO:58;

e) CDRL1 comprises SEQ ID NO:5, CDRL2 comprises SEQ ID NO:14, CDRL3 comprises SEQ ID NO:30, CDRH1 comprises SEQ ID NO:3, CDRH2 comprises SEQ ID NO:36 and CDRH3 comprises SEQ ID NO:63;

f) CDRL1 comprises SEQ ID NO:10, CDRL2 comprises SEQ ID NO:17, CDRL3 comprises SEQ ID NO:28, CDRH1 comprises SEQ ID NO:35, CDRH2 comprises SEQ ID NO:45 and CDRH3 comprises SEQ ID NO:76;

g) CDRL1 comprises SEQ ID NO:5, CDRL2 comprises SEQ ID NO:12, CDRL3 comprises SEQ ID NO:29, CDRH1 comprises SEQ ID NO:31, CDRH2 comprises SEQ ID NO:37 and CDRH3 comprises SEQ ID NO:58;

h) CDRL1 comprises SEQ ID NO:5, CDRL2 comprises SEQ ID NO:14, CDRL3 comprises SEQ ID NO:30, CDRH1 comprises SEQ ID NO:31, CDRH2 comprises SEQ ID NO:71 and CDRH3 comprises SEQ ID NO:63;

i) CDRL1 comprises SEQ ID NO:5, CDRL2 comprises SEQ ID NO:11, CDRL3 comprises SEQ ID NO:19, CDRH1 comprises SEQ ID NO:31, CDRH2 comprises SEQ ID NO:71 and CDRH3 comprises SEQ ID NO:47; or j) CDRL1 comprises SEQ ID NO:5, CDRL2 comprises SEQ ID NO:12, CDRL3 comprises SEQ ID NO:18, CDRH1 comprises SEQ ID NO:31, CDRH2 comprises SEQ ID NO:73 and CDRH3 comprises SEQ ID NO:52.

In a fourth embodiment, the antigen binding protein comprises a VL and a VH, and wherein:

a) the amino acid sequence of the VL is at least 80%, 85%, 90%, 95%, 97% or 99% identical to SEQ ID NO:119 and the amino acid sequence of VH is at least 80%, 85%, 90%, 95%, 97% or 99% identical to SEQ ID NO:138;
b) the amino acid sequence of the VL is at least 80%, 85%, 90%, 95%, 97% or 99% identical to SEQ ID NO:124 and the amino acid sequence of VH is at least 80%, 85%, 90%, 95%, 97% or 99% identical to SEQ ID NO:143;
c) the amino acid sequence of the VL is at least 80%, 85%, 90%, 95%, 97% or 99% identical to SEQ ID NO:134 and the amino acid sequence of VH is at least 80%, 85%, 90%, 95%, 97% or 99% identical to SEQ ID NO:153;
d) the amino acid sequence of the VL is at least 80%, 85%, 90%, 95%, 97% or 99% identical to SEQ ID NO:135 and the amino acid sequence of VH is at least 80%, 85%, 90%, 95%, 97% or 99% identical to SEQ ID NO:154;
e) the amino acid sequence of the VL is at least 80%, 85%, 90%, 95%, 97% or 99% identical to SEQ ID NO:136 and the amino acid sequence of VH is at least 80%, 85%, 90%, 95%, 97% or 99% identical to SEQ ID NO:155;
f) the amino acid sequence of the VL is at least 80%, 85%, 90%, 95%, 97% or 99% identical to SEQ ID NO:242 and the amino acid sequence of VH is at least 80%, 85%, 90%, 95%, 97% or 99% identical to SEQ ID NO:282;
g) the amino acid sequence of the VL is at least 80%, 85%, 90%, 95%, 97% or 99% identical to SEQ ID NO:255 and the amino acid sequence of VH is at least 80%, 85%, 90%, 95%, 97% or 99% identical to SEQ ID NO:295;
h) the amino acid sequence of the VL is at least 80%, 85%, 90%, 95%, 97% or 99% identical to SEQ ID NO:262 and the amino acid sequence of VH is at least 80%, 85%, 90%, 95%, 97% or 99% identical to SEQ ID NO:302;
i) the amino acid sequence of the VL is at least 80%, 85%, 90%, 95%, 97% or 99% identical to SEQ ID NO:267 and the amino acid sequence of VH is at least 80%, 85%, 90%, 95%, 97% or 99% identical to SEQ ID NO:307; or
j) the amino acid sequence of the VL is at least 80%, 85%, 90%, 95%, 97% or 99% identical to SEQ ID NO:272 and the amino acid sequence of VH is at least 80%, 85%, 90%, 95%, 97% or 99% identical to SEQ ID NO:312.

In a fifth embodiment, the antigen binding protein comprises a VL and a VH, and wherein:
a) the VL comprises SEQ ID NO:119 and the VH comprises SEQ ID NO:138;
b) the VL comprises SEQ ID NO:124 and the VH comprises SEQ ID NO:143;
c) the VL comprises SEQ ID NO:134 and the VH comprises SEQ ID NO:153;
d) the VL comprises SEQ ID NO:135 and the VH comprises SEQ ID NO:154;
e) the VL comprises SEQ ID NO:136 and the VH comprises SEQ ID NO:155;
f) the VL comprises SEQ ID NO:242 and the VH comprises SEQ ID NO:282;
g) the VL comprises SEQ ID NO:255 and the VH comprises SEQ ID NO:295;
h) the VL comprises SEQ ID NO:262 and the VH comprises SEQ ID NO:302;
i) the VL comprises SEQ ID NO:267 and the VH comprises SEQ ID NO:307;
j) the VL comprises SEQ ID NO:272 and the VH comprises SEQ ID NO:312.

In a sixth embodiment, the antigen binding protein comprises a LC and HC, and wherein:
a) the LC is at least 90%, 95%, 97% or 99% identical in amino acid sequence to SEQ ID NO:317 and the HC is at least 90%, 95%, 97% or 99% identical in amino acid sequence to SEQ ID NO:336;
b) the LC is at least 90%, 95%, 97% or 99% identical in amino acid sequence to SEQ ID NO:322 and the HC is at least 90%, 95%, 97% or 99% identical in amino acid sequence to SEQ ID NO:341;
c) the LC is at least 90%, 95%, 97% or 99% identical in amino acid sequence to SEQ ID NO:332 and the HC is at least 90%, 95%, 97% or 99% identical in amino acid sequence to SEQ ID NO:351;
d) the LC is at least 90%, 95%, 97% or 99% identical in amino acid sequence to SEQ ID NO:333 and the HC is at least 90%, 95%, 97% or 99% identical in amino acid sequence to SEQ ID NO:352;
e) the LC is at least 90%, 95%, 97% or 99% identical in amino acid sequence to SEQ ID NO:334 and the HC is at least 90%, 95%, 97% or 99% identical in amino acid sequence to SEQ ID NO:353;
f) the LC is at least 90%, 95%, 97% or 99% identical in amino acid sequence to SEQ ID NO:360 and the HC is at least 90%, 95%, 97% or 99% identical in amino acid sequence to SEQ ID NO:400;
g) the LC is at least 90%, 95%, 97% or 99% identical in amino acid sequence to SEQ ID NO:373 and the HC is at least 90%, 95%, 97% or 99% identical in amino acid sequence to SEQ ID NO:413;
h) the LC is at least 90%, 95%, 97% or 99% identical in amino acid sequence to SEQ ID NO:380 and the HC is at least 90%, 95%, 97% or 99% identical in amino acid sequence to SEQ ID NO:420;
i) the LC is at least 90%, 95%, 97% or 99% identical in amino acid sequence to SEQ ID NO:385 and the HC is at least 90%, 95%, 97% or 99% identical in amino acid sequence to SEQ ID NO:425;
j) the LC is at least 90%, 95%, 97% or 99% identical in amino acid sequence to SEQ ID NO:390 and the HC is at least 90%, 95%, 97% or 99% identical in amino acid sequence to SEQ ID NO:430.

In a seventh embodiment, the antigen binding protein comprises an LC and an HC, and wherein:
a) the LC comprises SEQ ID NO:317 and the HC comprises SEQ ID NO:336;
b) the LC comprises SEQ ID NO:322 and the HC comprises SEQ ID NO:341;
c) the LC comprises SEQ ID NO:332 and the HC comprises SEQ ID NO:351;
d) the LC comprises SEQ ID NO:333 and the HC comprises SEQ ID NO:352;
e) the LC comprises SEQ ID NO:334 and the HC comprises SEQ ID NO:353;
f) the LC comprises SEQ ID NO:360 and the HC comprises SEQ ID NO:400;
g) the LC comprises SEQ ID NO:373 and the HC comprises SEQ ID NO:413;
h) the LC comprises SEQ ID NO:380 and the HC comprises SEQ ID NO:420;
i) the LC comprises SEQ ID NO:385 and the HC comprises SEQ ID NO:425;

j) the LC comprises SEQ ID NO:390 and the HC comprises SEQ ID NO:430.

In an eighth embodiment, the antigen binding protein competes for binding to human GITR with a reference antigen binding protein, wherein the reference antigen binding protein is an antigen binding protein as described for the fifth embodiment.

In a ninth embodiment, the antigen binding protein of the eighth embodiment and the reference antibody cross-compete for binding to human GITR.

In a tenth embodiment, the antigen binding protein of any one of embodiments 1-9 has one or more of the following characteristics:
 a) is a monoclonal antibody;
 b) is a human antibody, a humanized antibody, or a chimeric antibody;
 c) is a multispecific antibody;
 d) is of the IgG1, IgG2, IgG3, or the IgG4 type;
 e) is an antigen-binding antibody fragment;
 f) is a Fab fragment, a Fab' fragment, a F(ab')2 fragment, or an Fv fragment;
 g) is a diabody, a single chain antibody, a domain antibody, or a nanobody;
 h) is labeled.

In an eleventh embodiment, the antigen binding protein of any one of embodiments 1-10 is a fully human antibody.

In a twelfth embodiment, the antigen binding protein of any one of embodiments 1-11 agonizes the activity of human GITR.

In a thirteenth embodiment, the antigen binding protein of any one embodiments 1-12 has one or more of the following activities:
 a) cross-competes with GITRL for binding to GITR;
 b) can be internalized into human CD4 cells;
 c) inhibits suppression of regulatory T cells;
 d) decreases circulating regulatory T cells;
 e) activates effector T cells;
 f) has a half life of at least 6, 7, 9 or 12 days in human serum.

In a fourteenth embodiment, the antigen binding protein of any one of embodiments 1-13 is a fully human IgG1 antibody.

In a fifteenth embodiment, the antigen binding protein of any one of embodiments 1-14 is capable of binding Fcgamma receptor (FcγR).

In a sixteenth embodiment, the antigen binding protein of any one of embodiments 1-15 is capable of binding Fcgamma receptor (FcγR) such that a cluster of antigen binding proteins is formed.

In a seventeenth embodiment, the antigen binding protein of any one of embodiments 1-16 binds human GITR (e.g., SEQ ID NO:1).

In an eighteenth embodiment, the antigen binding protein of any one embodiments 1-17 has one or more of the following characteristics:
 a) binds to human GITR polypeptide of SEQ ID NO:1 with a KD of less than ≤10 nM;
 b) binds to cyno GITR polypeptide of SEQ ID NO:2, with a KD of less than ≤500 nM.

In a nineteenth embodiment, the antigen binding protein of any one of embodiments 1-18 is a fully human monoclonal antibody of the IgG1 type that agonizes human GITR.

In a twentieth embodiment, the antigen binding protein of any one of embodiments 1-19 binds human GITR of SEQ ID NO:1 with $K_D \leq 10$ nM and binds cyno GITR of SEQ ID NO:2 with $K_D \leq 500$ nM.

In a twenty-first embodiment, the antigen binding protein of any one of embodiment 1-20 is glycosylated.

In a twenty-second embodiment, a nucleic acid is provided that encodes
 a) the VL, the VH or both of the antigen binding protein of any one of embodiments 1 to 20; or
 b) the LC or the HC or both of the antigen binding protein of any one of embodiments 1 to 20.

In a twenty-third embodiment, the nucleic acid comprises:
 a) the VL nucleotide sequence and/or the VH nucleotide sequence as set forth for any single antibody selected from the group of Ab1 to Ab59 inclusive;
 b) the LC nucleotide sequence and/or the HC nucleotide sequence as set forth for any single antibody selected from the group of Ab1 to Ab59 inclusive.

In a twenty-fourth embodiment, a vector is provided that comprises the nucleic acid of embodiment 22 or 23.

In a twenty-fifth embodiment, a cell is provided that comprises the nucleic acid of embodiment 22 or 23 or the vector of embodiment 24.

In a twenty-sixth embodiment, a method is provided for making an antigen binding protein of any one of embodiments 1 to 21, wherein the method comprises culturing the cell of embodiment 25 under conditions that allow expression of the antigen binding protein and optionally isolating the antigen binding protein from the culture.

In a twenty-seventh embodiment, a pharmaceutical composition is provided that comprises at least one antigen binding protein according to any one of embodiments 1 to 21 and a pharmaceutically acceptable carrier or diluent.

In a twenty-eighth embodiment, the pharmaceutical composition of embodiment of embodiment 27, further comprises an additional active ingredient selected from the group consisting of an immunostimulatory agent, an anti-angiogenic agent, and a chemotherapeutic agent.

In a twenty-ninth embodiment, the antigen binding protein of any one of embodiments 1-21 or the pharmaceutical composition of embodiment 27 or 28 is for use in therapy.

In a thirtieth embodiment, the antigen binding protein of any one of embodiments 1-21, or the pharmaceutical composition of embodiments 27 or 28 is for use in a method of inducing or enhancing an immune response in a subject, the method comprising administering the antigen binding protein to the subject.

In a thirty-first embodiment, a method for inducing or enhancing an immune response in a subject is provided, the method comprising administering the antigen binding protein of any one of embodiments 1 to 21 or the pharmaceutical composition of embodiment 27 or 28 to a subject in an amount effective to induce or enhance the immune response.

In a thirty-second embodiment, the method of embodiment 31 involves generating an immune response against a tumor antigen.

In a thirty-third embodiment, the method of embodiment 31 involves generating an immune response against an infectious agent.

In a thirty-fourth embodiment, the method of any one of embodiments 31-33 involves administering the antigen binding protein in an amount sufficient to achieve one or more of the following in the subject:
 a) reduce regulatory T cells suppression of activity of effector T cells;
 b) decrease levels of circulating regulatory T cells;
 c) activation of effector T cells;
 d) induce or enhance effector T cell proliferation;
 e) inhibit tumor growth; and
 f) induce tumor regression.

In a thirty-fifth embodiment, method for treating cancer in a subject with cancer is provided, in which the method comprises administering an effective amount of an antigen binding protein of any one of embodiments 1-21 or the pharmaceutical composition of embodiment 27 or 28 to the subject.

In a thirty-sixth embodiment, the method of embodiment 35 is to treat a solid cancer.

In a thirty-seventh embodiment, the method of embodiment 35 is to treat a hematological cancer.

In a thirty-eighth embodiment, the method of embodiment 35 is to treat melanoma, lung cancer, head and neck cancer, renal cell cancer, or colorectal cancer.

In a thirty-ninth embodiment, a method for inhibiting metastasis in a subject with cancer is provided, the method comprises administering an effective amount of an antigen binding protein of any one of embodiments 1-21 or the pharmaceutical composition of embodiment 27 or 28 to the subject.

In a fortieth embodiment, the method of any one of embodiments 31-39 further comprises one or more of the following
 a) administering chemotherapy;
 b) administering radiation therapy;
 c) administering one or more additional therapeutic agents.

In a forty-first embodiment, the method is as described for embodiment 40 and the additional therapeutic agent is an immunostimulatory agent.

In a forty-second embodiment, the method is as described for embodiment 41 and the immunostimulatory agent is selected from the group consisting of T-VEC, a PD 1 antagonist, a PDL1 antagonist, a CTLA-4 antagonist and a BiTE.

In a forty-third embodiment, the method is a described for embodiment 40, with the chemotherapy, radiation therapy, or therapeutic agent being administered before, concurrently or after the antigen binding protein.

In a forty-fourth embodiment, a method for treating a subject with an infection is provided, the method comprising administering an antigen binding protein of any one of embodiments 1 to 21, or the pharmaceutical composition of embodiments 27 or 28 in an amount effective to treat the infection.

BRIEF DESCRIPTION OF THE DRAWINGS

FIGS. 1A-1D are binding plots that collectively demonstrate that GITR antibodies such as provided herein cross-compete with human GITRL for binding to two different subpopulations of T cells, namely CD4+CD25+ T cells and CD8+CD25+ T cells. In particular, the results summarized in FIGS. 1A and 1B show that GITR antibodies such as provided herein block GITRL binding to these two subpopulations of T cells. In this part of the experiment, appropriately activated populations of T cells were incubated with varying molar concentrations of GITR antibodies (9H6, 5H7, 41G5) for 10 minutes, after which 4 mM His-tagged human GITRL was added and the mixture incubated for another 30 min. at 4 C. Cells were then washed and subsequently incubated with a fluorescently tagged anti-His antibody to detect bound GITRL. MFI (Mean Fluorescence Intensity) of bound GITRL was determined by flow cytometry. FIGS. 1A and 1B are plots of MFI as a function of the GITR antibody:GITRL molar concentration ratio for the two different cell populations. FIGS. 1C and 1D are plots showing the results of the reverse experiment, and demonstrate that GITRL can block the binding of the anti-GITR antibodies to the two T cell subpopulations. In these tests, varying concentrations of GITRL, rather than GITR antibody, were first incubated with appropriately activated populations of T cells. GITR antibodies (4 mM 9H6, 5H7, 41G5) were subsequently added and the resulting mixture incubated for 30 min. at 4 C. Bound GITR antibody was detected by incubating with fluorescently labeled anti-human Fc. Binding was determined by flow cytometry analysis. FIGS. 1C and 1D are plots of MFI as a function of the GITRL:GITR antibody molar concentration ratio for the two different cell populations.

FIG. 4B shows that FcγRIIIa has similar clustering activity. In each experiment, varying concentrations of GITR antibodies or a human IgG1 isotype control were added to co-cultures of primary human CD4+ T cells and 293T cells engineered to express one of the Fcgamma receptors. A low number of CD3 coated beads were added to provide suboptimal TCR stimulation. Cells were incubated for 96 hours and pulsed with 1 uCi 3H for the last 18 hours of culture to determine the amount of cell proliferation induced by the antibodies. The graphs are plots of 3H counts as a function of antibody concentration and represent mean±StDev of triplicate wells and are representative of 5 experiments from 5 human donors.

FIGS. 8A and 8B provide an alignment of the amino acid sequences of the variable domains of the light chain (VL) of the parental antibodies as provided herein. The CDRs (CDR1, CDR2 and CDR3) and framework regions (FR1, FR2, FR3 and FR4) are indicated. The full sequence spans the two figures, with FR1, CDR1, FR2 and CDR2 included on FIG. 8A and the FR3, CDR3 and FR4 regions extending onto FIG. 8B. The CDRs are defined by Kabat. The dashes simply account for the difference in numbering when alignment numbering is as defined according to the AHo numbering convention (see, e.g., Honegger, A. and Pluckthun, A. (2001) J. Mol. Biol. 309:657-670).

FIGS. 9A and 9B provide an alignment of the amino acid sequences of the variable domains of the heavy chain (VH) of the parental antibodies as provided herein. The CDRs (CDR1, CDR2 and CDR3) and framework regions (FR1, FR2, FR3 and FR4) are indicated. The full sequence spans the two figures, with FR1, CDR1, FR2 and CDR2 included on FIG. 9A and the FR3, CDR3 and FR4 regions extending onto FIG. 9B. The dashes simply account for the difference in numbering when alignment numbering is as defined according to the AHo numbering convention (see, e.g., Honegger, A. and Pluckthun, A. (2001) J. Mol. Biol. 309: 657-670, which is incorporated by reference herein in its entirety).

FIGS. 10A and 10B provide an alignment of the amino acid sequences of the variable domains of the light chains (VL) of the engineered antibodies as provided herein. The CDRs (CDR1, CDR2 and CDR3) and framework regions (FR1, FR2, FR3 and FR4) are indicated. The full sequence spans the two figures, with FR1, CDR1, FR2 and CDR2 included on FIG. 10A and the FR3, CDR3 and FR4 regions extending onto FIG. 10B. The dashes simply account for the difference in numbering when alignment numbering is as defined according to the AHo numbering convention (see, e.g., Honegger, A. and Pluckthun, A. (2001) J. Mol. Biol. 309:657-670).

FIGS. 11A and 11B provide an alignment of the amino acid sequences of the variable domains of the heavy chains (VH) of the engineered antibodies as provided herein. The CDRs (CDR1, CDR2 and CDR3) and framework regions (FR1, FR2, FR3 and FR4) are indicated. The full sequence spans the two figures, with FR1, CDR1, FR2 and CDR2 included on FIG. 11A and the FR3, CDR3 and FR4 regions extending onto FIG. 11B. The dashes simply account for the difference in numbering when alignment numbering is as defined according to the AHo numbering convention (see, e.g., Honegger, A. and Pluckthun, A. (2001) J. Mol. Biol. 309:657-670).

As seen in FIGS. 12A and 12B, both Fcgamma RIIa (FIG. 12A) and RIIIa (FIG. 12B) were able to cluster the native IgG1 GITR antibody and drive proliferation of effector T cells. The aglycosylated antibody, however, did not show any activity due to its inability to bind and be clustered by Fcgamma Rs.

DETAILED DESCRIPTION

Figure 2:
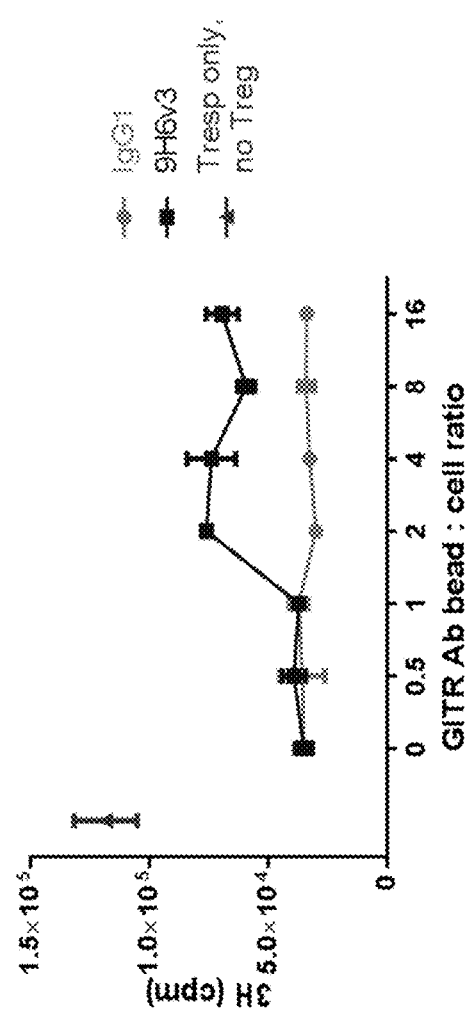
FIG. 2 is a graph illustrating that GITR antibodies such as described herein can reduce suppression of effector T cells by regulatory T cells (Tregs). In the experiment, Treg cells and T responders were incubated with equal numbers of T cell activation beads and with varying concentrations of beads coated with a representative GITR antibody for 5 days. Cells were pulsed with 1 uCi of 3H during the last 16 hours of culture, harvested and counts determined. The plot is the number of counts as a function of the GITR antibody-coated bead:cell ratio.

The section headings used herein are for organizational purposes only and are not to be construed as limiting the subject matter described.

Unless otherwise defined herein, scientific and technical terms used in connection with the present application have the meanings that are commonly understood by those of ordinary skill in the art. Further, unless otherwise required by context, singular terms shall include pluralities and plural terms shall include the singular.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present application are generally performed according to conventional methods well known in the art and as described in various general and more specific references that are cited and discussed throughout the present specification unless otherwise indicated. See, e.g., Sambrook et al., Molecular Cloning: A Laboratory Manual, 3rd ed., Cold Spring Harbor Laboratory Press, Cold Spring Harbor, N.Y. (2001), Ausubel et al., Current Protocols in Molecular Biology, Greene Publishing Associates (1992), and Harlow and Lane Antibodies: A Laboratory Manual Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well known and commonly used in the art. Standard techniques can be used for chemical syntheses, chemical analyses, pharmaceutical preparation, formulation, and delivery, and treatment of patients.

It should be understood that this invention is not limited to the particular methodology, protocols, and reagents, etc., described herein and as such may vary. The terminology used herein is for the purpose of describing particular embodiments only, and is not intended to limit the scope of the disclosed, which is defined solely by the claims.

Other than in the operating examples, or where otherwise indicated, all numbers expressing quantities of ingredients or reaction conditions used herein should be understood as modified in all instances by the term "about." The term "about" when used in connection with percentages may mean±1%.

All embodiments narrower in scope in any way than the variations defined by specific paragraphs herein are to be considered included in this disclosure. For example, certain aspects are described as a genus, and it should be understood that every member of a genus can be, individually, an embodiment. Also, aspects described as a genus or selecting a member of a genus should be understood to embrace combinations of two or more members of the genus. It should also be understood that while various embodiments in the specification are presented using "comprising" language, under various circumstances, a related embodiment may also be described using "consisting of" or "consisting essentially of" language.

In this application, the use of "or" means "and/or" unless stated otherwise. Furthermore, the use of the term "including," as well as other forms, such as "includes" and "included", is not limited. Also, terms such as "element" or "component" encompass both elements and components comprising one unit and elements and components that comprise more than one subunit unless specifically stated otherwise.

I. Definitions

As used herein, the term "GITR," refers to "Glucocorticoid-induced TNF-related gene," also referred to in the art as TNF receptor superfamily 18 (TNFRSF 18). The amino acid and nucleic acid sequence for human and murine forms of GITR are described in WO 98/06842, which is incorporated herein by reference. See also GenBank deposit Q9Y5U5 (human amino acid sequence) and AF109216 (murine nucleic acid and amino acid sequences). The amino acid sequence of one specific example of a mature human GITR polypeptide is set forth in SEQ ID NO:1. An exemplary mature GITR protein from cynomolgus monkey has the amino acid sequence as shown in SEQ ID NO:2. The amino acid sequence of a mature GITR from mouse is shown in SEQ ID NO:3. The term GITR as used herein also includes naturally occurring alleles.

As used herein, the term "GITRL" refers to the naturally-occurring ligand for GITR. The amino acid sequence for a GITRL polypeptide is provided in GenBank deposit AAQ89227. An exemplary amino acid sequence for human GITRL is provided in SEQ ID NO:4.

An "antigen binding protein" as used herein means any protein that specifically binds a specified target antigen, such as an GITR polypeptide (e.g., a human GITR polypeptide such as provided in SEQ ID NO:1). The term includes polypeptides that include at least one antigen binding region. The term also encompasses intact antibodies that comprise at least two full-length heavy chains and two full-length light chains, as well as derivatives, variants, fragments, and mutations thereof, examples of which include Fab, Fab', F(ab')$_2$, Fv fragments. An antigen binding protein also includes domain antibodies such as nanobodies and single-chain antibodies as described further below, as well as bispecific antibodies. The term does not include GITRL.

In general, an GITR antigen binding protein is said to "specifically bind" its target antigen GITR when the antigen binding protein exhibits essentially background binding to non-GITR molecules. An antigen binding protein that specifically binds GITR may, however, cross-react with GITR polypeptides from different species. Typically, a GITR antigen binding protein specifically binds human GITR when the dissociation constant ($K_D$) is $\leq 10^{-7}$ M as measured via a surface plasma resonance technique (e.g., BIACore, GE-Healthcare Uppsala, Sweden). An GITR antigen binding protein specifically binds human GITR with "high affinity" when the $K_D$ is $\leq 5 \times 10^{-8}$ M, and with "very high affinity" when the $K_D$ is $\leq 5 \times 10^{-9}$ M, again as measured using a method such as BIACore.

"Antigen binding region" means the portion of a protein, such as an antibody or a fragment, derivative, or variant thereof, that specifically binds a specified antigen. For example, that portion of an antigen binding protein that contains the amino acid residues that interact with an antigen and confer on the antigen binding protein its specificity and affinity for the antigen is referred to as "antigen binding region." An antigen binding region can include one or more "complementarity determining regions" ("CDRs"). Certain antigen binding regions also include one or more "framework" regions. A "CDR" is an amino acid sequence that contributes to antigen binding specificity and affinity. "Framework" regions can contribute directly to the specific binding of the antigen binding protein, but typically aid in maintaining the proper conformation of the CDRs to promote binding between the antigen binding region and an antigen.

A "recombinant protein", including a recombinant GITR antigen binding protein, is a protein made using recombinant techniques, i.e., through the expression of a recombinant nucleic acid as described herein. Methods and techniques for the production of recombinant proteins are well known in the art.

The term "antibody" refers to an intact immunoglobulin of any isotype, or a fragment thereof that can compete with the intact antibody for specific binding to the target antigen, and includes, for instance, chimeric, humanized, fully human, and bispecific antibodies. An "antibody" as such is a species of an antigen binding protein. In some embodiments, an intact antibody comprises at least two full-length heavy chains and two full-length light chains. In other embodiments, an intact antibody includes fewer chains such as antibodies naturally occurring in camelids which may comprise only heavy chains. Antibodies may be derived solely from a single source, or may be "chimeric," that is, different portions of the antibody may be derived from two different antibodies as described further below. The antigen binding proteins, antibodies, or binding fragments may be produced in hybridomas, by recombinant DNA techniques, or by enzymatic or chemical cleavage of intact antibodies. Unless otherwise indicated, the term "antibody" includes, in addition to antibodies comprising two full-length heavy chains and two full-length light chains, derivatives, variants, fragments, and mutations thereof, examples of which include Fab, Fab', F(ab')$_2$, Fv fragments, domain antibodies such as Nanobodies® and single-chain antibodies as described in more detail below.

The term "light chain" as used with respect to an antigen binding protein, antibody or fragments thereof includes a full-length light chain and fragments thereof having sufficient variable region sequence to confer binding specificity. A full-length light chain includes a variable region domain, $V_L$, and a constant region domain, $C_L$. The variable region domain of the light chain is at the amino-terminus of the polypeptide. Light chains include kappa chains and lambda chains.

The term "heavy chain" as used with respect to an antigen binding protein, antibody or fragment thereof includes a full-length heavy chain and fragments thereof having sufficient variable region sequence to confer binding specificity. A full-length heavy chain includes a variable region domain, $V_H$, and three constant region domains, $C_H1$, $C_H2$, and $C_H3$. The $V_H$ domain is at the amino-terminus of the polypeptide, and the $C_H$ domains are at the carboxyl-terminus, with the $C_H3$ being closest to the carboxy-terminus of the polypeptide. Heavy chains may be of any isotype, including IgG (including IgG1, IgG2, IgG3 and IgG4 subtypes), IgA (including IgA1 and IgA2 subtypes), IgM and IgE.

The term "immunologically functional fragment" (or simply "fragment") of an antibody or immunoglobulin chain (heavy or light chain), as used herein, is an antigen binding protein comprising a portion (regardless of how that portion is obtained or synthesized) of an antibody that lacks at least some of the amino acids present in a full-length chain but which is capable of specifically binding to an antigen. Such fragments are biologically active in that they bind specifically to the target antigen and can compete with other antigen binding proteins, including intact antibodies, for specific binding to a given epitope. In one aspect, such a fragment will retain at least one CDR present in the full-length light or heavy chain, and in some embodiments will comprise a single heavy chain and/or light chain or portion thereof. These biologically active fragments may be produced by recombinant DNA techniques, or may be produced by enzymatic or chemical cleavage of antigen binding proteins, including intact antibodies Immunologically functional immunoglobulin fragments include, but are not limited to, Fab, Fab', F(ab')$_2$, Fv, domain antibodies and single-chain antibodies, and may be derived from any mammalian source, including but not limited to human, mouse, rat, camelids or rabbit. It is contemplated further that a functional portion of the antigen binding proteins disclosed herein, for example, one or more CDRs, could be covalently bound to a second protein or to a small molecule to create a therapeutic agent directed to a particular target in the body, possessing bifunctional therapeutic properties, or having a prolonged serum half-life.

An "Fab fragment" is comprised of one light chain and the $C_H1$ and variable regions of one heavy chain. The heavy chain of a Fab molecule cannot form a disulfide bond with another heavy chain molecule.

An "Fe" region contains two heavy chain fragments comprising the $C_H2$ and $C_H3$ domains of an antibody. The two heavy chain fragments are held together by two or more disulfide bonds and by hydrophobic interactions of the $C_H3$ domains.

An "Fab' fragment" contains one light chain and a portion of one heavy chain that contains the $V_H$ domain and the $C_H1$ domain and also the region between the $C_H1$ and $C_H2$ domains, such that an interchain disulfide bond can be formed between the two heavy chains of two Fab' fragments to form an F(ab')$_2$ molecule.

An "F(ab')$_2$ fragment" contains two light chains and two heavy chains containing a portion of the constant region between the $C_H1$ and $C_H2$ domains, such that an interchain disulfide bond is formed between the two heavy chains. A F(ab')$_2$ fragment thus is composed of two Fab' fragments that are held together by a disulfide bond between the two heavy chains.

The "Fv region" comprises the variable regions from both the heavy and light chains, but lacks the constant regions.

"Single-chain antibodies" are Fv molecules in which the heavy and light chain variable regions have been connected by a flexible linker to form a single polypeptide chain, which forms an antigen-binding region. Single chain antibodies are discussed in detail in International Patent Application Publication No. WO 88/01649 and U.S. Pat. No. 4,946,778 and U.S. Pat. No. 5,260,203.

A "domain antibody" is an immunologically functional immunoglobulin fragment containing only the variable region of a heavy chain or the variable region of a light chain. Examples of domain antibodies include Nanobodies®. In some instances, two or more $V_H$ regions are covalently joined with a peptide linker to create a bivalent domain antibody. The two $V_H$ regions of a bivalent domain antibody may target the same or different antigens.

A "bivalent antigen binding protein," "bivalent antibody" or "bi-specific antibody" comprises two antigen binding regions. In some instances, the two binding regions have the same antigen specificities. Bivalent antigen binding proteins and bivalent antibodies may be bispecific.

A multispecific antigen binding protein" or "multispecific antibody" is one that targets more than one antigen or epitope.

A "bispecific," "dual-specific" or "bifunctional" antigen binding protein or antibody is a hybrid antigen binding protein or antibody, respectively, having two different antigen binding sites. Bispecific antigen binding proteins and antibodies are a species of multispecific antigen binding protein or multispecific antibody and may be produced by a variety of methods including, but not limited to, fusion of hybridomas or linking of Fab' fragments. See, e.g., Songsivilai and Lachmann, 1990, Clin. Exp. Immunol. 79:315-321; Kostelny et al., 1992, J. Immunol. 148:1547-1553. The two binding sites of a bispecific antigen binding protein or antibody will bind to two different epitopes, which may reside on the same or different protein targets.

The term "compete" when used in the context of antigen binding proteins (e.g., antibodies) that compete for the same epitope means competition between antigen binding proteins and is determined by an assay in which the antigen binding protein (e.g., antibody or immunologically functional fragment thereof) under test prevents or inhibits specific binding of a reference antigen binding protein to a common antigen (e.g., GITR or a fragment thereof). Numerous types of competitive binding assays can be used, for example: solid phase direct or indirect radioimmunoassay (RIA), solid phase direct or indirect enzyme immunoassay (EIA), sandwich competition assay (see, e.g., Stahli et al., 1983, Methods in Enzymology 9:242-253); solid phase direct biotin-avidin EIA (see, e.g., Kirkland et al., 1986, J. Immunol. 137:3614-3619) solid phase direct labeled assay, solid phase direct labeled sandwich assay (see, e.g., Harlow and Lane, 1988, Antibodies, A Laboratory Manual, Cold Spring Harbor Press); solid phase direct label RIA using 1-125 label (see, e.g., Morel et al., 1988, Molec. Immunol. 25:7-15); solid phase direct biotin-avidin EIA (see, e.g., Cheung, et al., 1990, Virology 176:546-552); and direct labeled RIA (Moldenhauer et al., 1990, Scand. J. Immunol. 32:77-82). Typically, such an assay involves the use of purified antigen bound to a solid surface or cells expressing the antigen, an unlabelled test antigen binding protein and a labeled reference antigen binding protein. Competitive inhibition is measured by determining the amount of label bound to the solid surface or cells in the presence of the test antigen binding protein. Usually the test antigen binding protein is present in excess. Antigen binding proteins identified by competition assay (competing antigen binding proteins) include antigen binding proteins binding to the same epitope as the reference antigen binding proteins and antigen binding proteins binding to an adjacent epitope sufficiently proximal to the epitope bound by the reference antigen binding protein for steric hindrance to occur. Additional details regarding methods for determining competitive binding are provided in the examples herein. For instance, in one embodiment, competition is determined according to a Bia-Core assay. Usually, when a competing antigen binding protein is present in excess, it will inhibit specific binding of a reference antigen binding protein to a common antigen by at least 20%, 25%, 30%, 35%, 40%, 45%, 50%, 55%, 60%, 65%, 70% or 75%. In some instances, binding is inhibited by at least 80%, 85%, 90%, 95%, or 97% or more.

The term "antigen" refers to a molecule or a portion of a molecule capable of being bound by a selective binding agent, such as an antigen binding protein (including, e.g., an antibody), and additionally capable of being used in an animal to produce antibodies capable of binding to that antigen. An antigen may possess one or more epitopes that are capable of interacting with different antigen binding proteins, e.g., antibodies.

The term "epitope" is the portion of a molecule that is bound by an antigen binding protein (for example, an antibody). The term includes any determinant capable of specifically binding to an antigen binding protein, such as an antibody. An epitope can be contiguous or non-contiguous (discontinuous) (e.g., in a polypeptide, amino acid residues that are not contiguous to one another in the polypeptide sequence but that within the context of the molecule are bound by the antigen binding protein). A conformational epitope is an epitope that exists within the conformation of an active protein but is not present in a denatured protein. In certain embodiments, epitopes may be mimetic in that they comprise a three dimensional structure that is similar to an epitope used to generate the antigen binding protein, yet comprise none or only some of the amino acid residues found in that epitope used to generate the antigen binding protein. Most often, epitopes reside on proteins, but in some instances may reside on other kinds of molecules, such as nucleic acids. Epitope determinants may include chemically active surface groupings of molecules such as amino acids, sugar side chains, phosphoryl or sulfonyl groups, and may have specific three dimensional structural characteristics, and/or specific charge characteristics. Generally, antigen binding proteins specific for a particular target antigen will preferentially recognize an epitope on the target antigen in a complex mixture of proteins and/or macromolecules.

"Amino acid" includes its normal meaning in the art. The twenty naturally-occurring amino acids and their abbreviations follow conventional usage. See, Immunology-A Synthesis, 2nd Edition, (E. S. Golub and D. R. Green, eds.), Sinauer Associates: Sunderland, Mass. (1991), incorporated herein by reference for any purpose. Stereoisomers (e.g., D-amino acids) of the twenty conventional amino acids, unnatural amino acids such as [alpha]-, [alpha]-disubstituted amino acids, N-alkyl amino acids, and other unconventional amino acids may also be suitable components for polypeptides and are included in the phrase "amino acid." Examples of unconventional amino acids include: 4-hydroxyproline, [gamma]-carboxyglutamate, [epsilon]-N,N,N-trimethyllysine, [epsilon]-N-acetyllysine, O-phosphoserine, N-acetylserine, N-formylmethionine, 3-methylhistidine, 5-hydroxylysine, [sigma]-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention.

The terms "polypeptide" or "protein" are used interchangeably herein to refer to a polymer of amino acid residues. The terms also apply to amino acid polymers in which one or more amino acid residues is an analog or mimetic of a corresponding naturally occurring amino acid, as well as to naturally occurring amino acid polymers. The terms can also encompass amino acid polymers that have been modified, e.g., by the addition of carbohydrate residues to form glycoproteins, or phosphorylated. Polypeptides and proteins can be produced by a naturally-occurring and non-recombinant cell or by a genetically-engineered or recombinant cell, and can comprise molecules having the amino acid sequence of the native protein, or molecules having deletions from, additions to, and/or substitutions of one or more amino acids of the native sequence. The terms "polypeptide" and "protein" specifically encompass GITR antigen-binding proteins, antibodies, or sequences that have deletions from, additions to, and/or substitutions of one or more amino acids of an antigen-binding protein. The term "polypeptide fragment" refers to a polypeptide that has an amino-terminal deletion, a carboxyl-terminal deletion, and/or an internal deletion as compared with the full-length protein. Such fragments may also contain modified amino acids as compared with the full-length protein. In certain embodiments, fragments are about five to 500 amino acids long. For example, fragments may be at least 5, 6, 8, 10, 14, 20, 50, 70, 100, 110, 150, 200, 250, 300, 350, 400 or 450 amino acids long. Useful polypeptide fragments include immunologically functional fragments of antibodies, including binding domains. In the case of an GITR antibody, useful fragments include but are not limited to a CDR region, a variable domain of a heavy or light chain, a portion of an antibody chain or just its variable region including two CDRs, and the like.

The term "isolated protein" means that a subject protein (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated protein" constitutes at least about 5%, at least about 10%, at least about 25%, or at least about 50% of a given sample. Genomic DNA, cDNA, mRNA or other RNA, of synthetic origin, or any combination thereof may encode such an isolated protein. Preferably, the isolated protein is substantially free from proteins or polypeptides or other contaminants that are found in its natural environment that would interfere with its therapeutic, diagnostic, prophylactic, research or other use.

A "variant" of a polypeptide (e.g., an antigen binding protein such as an antibody) comprises an amino acid sequence wherein one or more amino acid residues are inserted into, deleted from and/or substituted into the amino acid sequence relative to another polypeptide sequence. Variants include fusion proteins.

A "derivative" of a polypeptide is a polypeptide (e.g., an antigen binding protein such as an antibody) that has been chemically modified in some manner distinct from insertion, deletion, or substitution variants, e.g., via conjugation to another chemical moiety.

The term "naturally occurring" as used throughout the specification in connection with biological materials such as polypeptides, nucleic acids, host cells, and the like, refers to materials which are found in nature.

The term "polynucleotide" or "nucleic acid" includes both single-stranded and double-stranded nucleotide polymers. The nucleotides comprising the polynucleotide can be ribonucleotides or deoxyribonucleotides or a modified form of either type of nucleotide. The modifications include base modifications such as bromouridine and inosine derivatives, ribose modifications such as 2',3'-dideoxyribose, and internucleotide linkage modifications such as phosphorothioate, phosphorodithioate, phosphoroselenoate, phosphorodiselenoate, phosphoroanilothioate, phoshoraniladate and phosphoroamidate.

The term "oligonucleotide" means a polynucleotide comprising 200 or fewer nucleotides. In some embodiments, oligonucleotides are 10 to 60 bases in length. In other embodiments, oligonucleotides are 12, 13, 14, 15, 16, 17, 18, 19, or 20 to 40 nucleotides in length. Oligonucleotides may be single stranded or double stranded, e.g., for use in the construction of a mutant gene. Oligonucleotides may be sense or antisense oligonucleotides. An oligonucleotide can include a label, including a radiolabel, a fluorescent label, a hapten or an antigenic label, for detection assays. Oligonucleotides may be used, for example, as PCR primers, cloning primers or hybridization probes.

An "isolated nucleic acid molecule" means a DNA or RNA of genomic, mRNA, cDNA, or synthetic origin or some combination thereof which is not associated with all or a portion of a polynucleotide in which the isolated polynucleotide is found in nature, or is linked to a polynucleotide to which it is not linked in nature. For purposes of this disclosure, it should be understood that "a nucleic acid molecule comprising" a particular nucleotide sequence does not encompass intact chromosomes. Isolated nucleic acid molecules "comprising" specified nucleic acid sequences may include, in addition to the specified sequences, coding sequences for up to ten or even up to twenty other proteins or portions thereof, or may include operably linked regulatory sequences that control expression of the coding region of the recited nucleic acid sequences, and/or may include vector sequences.

Unless specified otherwise, the left-hand end of any single-stranded polynucleotide sequence discussed herein is the 5' end; the left-hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

The term "control sequence" refers to a polynucleotide sequence that can affect the expression and processing of coding sequences to which it is ligated. The nature of such control sequences may depend upon the host organism. In particular embodiments, control sequences for prokaryotes may include a promoter, a ribosomal binding site, and a transcription termination sequence. For example, control sequences for eukaryotes may include promoters comprising one or a plurality of recognition sites for transcription factors, transcription enhancer sequences, and transcription termination sequences. "Control sequences" can include leader sequences and/or fusion partner sequences.

The term "vector" means any molecule or entity (e.g., nucleic acid, plasmid, bacteriophage or virus) used to transfer protein coding information into a host cell.

The term "expression vector" or "expression construct" refers to a vector that is suitable for transformation of a host cell and contains nucleic acid sequences that direct and/or control (in conjunction with the host cell) expression of one or more heterologous coding regions operatively linked thereto. An expression construct may include, but is not limited to, sequences that affect or control transcription, translation, and, if introns are present, affect RNA splicing of a coding region operably linked thereto.

As used herein, "operably linked" means that the components to which the term is applied are in a relationship that allows them to carry out their inherent functions under suitable conditions. For example, a control sequence in a vector that is "operably linked" to a protein coding sequence is ligated thereto so that expression of the protein coding sequence is achieved under conditions compatible with the transcriptional activity of the control sequences.

The term "host cell" means a cell that has been transformed with a nucleic acid sequence and thereby expresses a gene of interest. The term includes the progeny of the parent cell, whether or not the progeny is identical in morphology or in genetic make-up to the original parent cell, so long as the gene of interest is present.

The term "identity" refers to a relationship between the sequences of two or more polypeptide molecules or two or more nucleic acid molecules, as determined by aligning and comparing the sequences. "Percent identity" means the percent of identical residues between the amino acids or nucleotides in the compared molecules and is calculated based on the size of the smallest of the molecules being compared. For these calculations, gaps in alignments (if any) must be addressed by a particular mathematical model or computer program (i.e., an "algorithm"). Methods that can be used to calculate the identity of the aligned nucleic acids or polypeptides include those described in Computational Molecular Biology, (Lesk, A. M., ed.), 1988, New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., 1987, Sequence Analysis in Molecular Biology, New York: Academic Press; Sequence Analysis Primer, (Gribskov, M. and Devereux, J., eds.), 1991, New York: M. Stockton Press; and Carillo et al., 1988, SIAM J. Applied Math. 48:1073.

In calculating percent identity, the sequences being compared are aligned in a way that gives the largest match between the sequences. The computer program used to determine percent identity is the GCG program package, which includes GAP (Devereux et al., 1984, Nucl. Acid Res. 12:387; Genetics Computer Group, University of Wisconsin, Madison, Wis.). The computer algorithm GAP is used to align the two polypeptides or polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., 1978, Atlas of Protein Sequence and Structure 5:345-352 for the PAM 250 comparison matrix; Henikoff et al., 1992, Proc. Natl. Acad. Sci. U.S.A. 89:10915-10919 for the BLOSUM 62 comparison matrix) is also used by the algorithm.

Recommended parameters for determining percent identity for polypeptides or nucleotide sequences using the GAP program are the following:

Algorithm: Needleman et al., 1970, J. Mol. Biol. 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences may result in matching of only a short region of the two sequences, and this small aligned region may have very high sequence identity even though there is no significant relationship between the two full-length sequences. Accordingly, the selected alignment method (GAP program) can be adjusted if so desired to result in an alignment that spans at least 50 contiguous amino acids of the target polypeptide.

As used herein, "substantially pure" means that the described species of molecule is the predominant species present, that is, on a molar basis it is more abundant than any other individual species in the same mixture. In certain embodiments, a substantially pure molecule is a composition wherein the object species comprises at least 50% (on a molar basis) of all macromolecular species present. In other embodiments, a substantially pure composition will comprise at least 80%, 85%, 90%, 95%, or 99% of all macromolecular species present in the composition. In other embodiments, the object species is purified to essential homogeneity wherein contaminating species cannot be detected in the composition by conventional detection methods and thus the composition consists of a single detectable macromolecular species.

The term "treating" refers to any indication of success in the treatment or amelioration of an injury, pathology or condition, including any objective or subjective parameter such as abatement; remission; diminishing of symptoms or making the injury, pathology or condition more tolerable to the patient; slowing in the rate of degeneration or decline; making the final point of degeneration less debilitating; improving a patient's physical or mental well-being. The treatment or amelioration of symptoms can be based on objective or subjective parameters; including the results of a physical examination, neuropsychiatric exams, and/or a psychiatric evaluation. For example, certain methods presented herein successfully treat cancer and tumors, by, for instance, decreasing the progression or spreading of the cancer, inhibiting tumor growth, causing remission of the tumor and/or ameliorating a symptom associated with the cancer or tumor. Likewise, other methods provided herein treat infectious disease by decreasing the progression or spread of the infection, reducing the extent of the infection and/or ameliorating a symptom associated with the infection.

An "effective amount" is generally an amount sufficient to reduce the severity and/or frequency of symptoms, eliminate the symptoms and/or underlying cause, prevent the occurrence of symptoms and/or their underlying cause, and/or improve or remediate the damage that results from or is associated with cancer. In some embodiments, the effective amount is a therapeutically effective amount or a prophylactically effective amount. A "therapeutically effective amount" is an amount sufficient to remedy a disease state (e.g. cancer) or symptoms, particularly a state or symptoms associated with the disease state, or otherwise prevent, hinder, retard or reverse the progression of the disease state or any other undesirable symptom associated with the disease in any way whatsoever. A "prophylactically effective amount" is an amount of a pharmaceutical composition that, when administered to a subject, will have the intended prophylactic effect, e.g., preventing or delaying the onset (or reoccurrence) of cancer, or reducing the likelihood of the onset (or reoccurrence) of cancer or cancer symptoms. The full therapeutic or prophylactic effect does not necessarily occur by administration of one dose, and may occur only after administration of a series of doses. Thus, a therapeutically or prophylactically effective amount may be administered in one or more administrations.

The phrase "GITR-associated disease" and other similar phrases refers to a disease or symptom associated with the disease that is treatable by inducing or enhancing GITR activity, e.g., via the use of an agonist GITR antibody as provided herein.

The terms "cancer", "tumor", "cancerous", and "malignant" refer to or describe the physiological condition in mammals that is typically characterized by unregulated cell growth. Examples of cancer include but are not limited to, carcinoma including adenocarcinoma, lymphoma, blastoma, melanoma, sarcoma, and leukemia. More particular examples of such cancers include melanoma, lung cancer, head and neck cancer, renal cell cancer, colon cancer, colorectal cancer, squamous cell cancer, small-cell lung cancer, non-small cell lung cancer, gastrointestinal cancer, Hodgkin's and non-Hodgkin's lymphoma, pancreatic cancer, glioblastoma, glioma, cervical cancer, ovarian cancer, liver cancer such as hepatic carcinoma and hepatoma, bladder cancer, breast cancer, endometrial carcinoma, myeloma (such as multiple myeloma), salivary gland carcinoma, kidney cancer such as renal cell carcinoma and Wilms' tumors, basal cell carcinoma, prostate cancer, vulval cancer, thyroid cancer, testicular cancer, and esophageal cancer.

A "tumor" refers to the mass of tissue formed as cancerous cells grow and multiply, which can invade and destroy normal adjacent tissues. Cancer cells can break away from a malignant tumor and enter the bloodstream or lymphatic system, such that cancer cells spread from the primary tumor to form new tumors in other organs.

A "solid tumor" refers to an abnormal growth or mass of tissue that usually does not contain cysts or liquid areas. Solid tumors may be benign (not cancerous) or malignant (cancerous). Different types of solid tumors are named for the type of cells that form them. Examples of solid tumors are sarcomas, carcinomas, and lymphomas. Leukemias (cancers of the blood) generally do not form solid tumors "Hematological cancers" are cancer that begins in blood-forming tissue, such as the bone marrow, or in the cells of the immune system. Examples of hematologic cancer are leukemia, lymphoma, and multiple myeloma.

A "subject" or "patient" as used herein can be any mammal. In a typical embodiment, the subject or patient is a human.

An "agonist" as used herein generally refers to a molecule, for example, an antigen binding protein such as provided herein, that can bind GITR and trigger GITR signaling.

The phrase "immune modulator" refers to a molecule that induces, enhances or suppresses an immune response. An immune activator is a molecule that induces or amplifies an immune response. An immune suppressor is a molecule that reduces or suppresses an immune response. Thus, an activation immunotherapy is a therapy that involves administering a molecule(s) to induce or enhance a subject's immune system. A suppression immunotherapy is a therapy in which a subject is treated with a molecule(s) to reduce or suppress the subject's immune system.

II. Overview

A variety of selective binding agents useful for modulating the activity of GITR are provided. These agents include, for instance, antigen binding proteins that contain an antigen binding domain that specifically binds to a GITR polypeptide, in particular human GITR (e.g., SEQ ID NO:1). The antigen binding proteins that are provided are GITR agonists and can thus induce or enhance GITR signaling. In view of their activity as GITR agonists, the antigen binding proteins that are provided can be used in a variety of immunotherapy applications.

The antigen binding proteins that are described herein were obtained through an extensive selection process to identify antibodies that would be suitable for immunotherapy, in particular as immunostimulants. The first selection was the decision to generate fully human antibodies rather than humanized or chimeric antibodies. Fully human antibodies were chosen to mitigate the risk that antibodies might be generated against the anti-GITR antibodies themselves when administered to a subject—a risk expected to be magnified in immunotherapy applications in which a GITR antibody is administered to upregulate a subject's immune response.

The process for obtaining such fully human antibodies was initiated by conducting three separate immunization campaigns in Xenomouse® animals. These campaigns employed three different immunization strategies and three different strains of mice in an effort to maximize the number and sequence diversity of the antibodies from which lead candidates could be selected. The resulting initial antibodies obtained from these three campaigns were then evaluated through multiple rounds of sequence-based, biophysical and functional screens to identify a group of parental antibodies with desired properties. Engineered variants of these parental antibodies were subsequently produced with the goal of further improving one or more features of the selected parental antibodies. Finally, a group of antibodies from the parental and engineered antibodies were selected for further analysis.

For instance, with respect to sequence analysis, the parental antibodies were selected from the initial antibodies on the basis of a number of criteria, such as propensity for oxidation, deamination, isomerization, acid hydrolysis and/or aggregation, as well as immunogenicity. Biophysical analysis included evaluating the antibodies on the basis of expression level, aggregation propensity, and stability. Functionally, the parental antibodies were selected with respect to activities such as affinity for GITR, ability to activate and stimulate effector T cells and ability to abrogate suppression by regulatory T cells.

The selected parental antibodies were then engineered in an effort to improve the antibodies. The final selection from the parental antibodies and the engineered forms thereof was also based upon a number of criteria, including stability of cell line, purification attributes, manufacturing assessment and desired functional attributes.

In some embodiments, antigen binding proteins are selected because they exhibit differential binding to different subclasses of T cells. In particular, such antigen binding proteins bind more strongly to CD4+CD25+ T cells than CD4+CD25− T cells and bind more strongly to CD8+CD25+ T cells than CD8+CD25− T cells. This selectivity in binding differs from that observed with some other known GITR antibodies. The selectivity may be important because the differential binding observed with the GITR antigen binding proteins provided herein is similar to that seen with the natural ligand, GITRL. As such, the selectivity in binding may reduce the potential for undesirable effects associated with non-specific binding to other T cell subsets and more closely mimic the binding of GITRL.

In an embodiment, antigen binding proteins are also selected such that the Fc region is glycosylated. Thus, for instance, the antigen binding protein may be an antibody in which the heavy chain is of the IgG1 subtype. Glycosylation of the Fc domain can be important in the ability of the antibody to bind the Fcgamma receptor and form clusters of antibodies. Such clustering can be important in the ability of certain antigen binding proteins to induce or enhance GITR signaling most effectively.

As noted above, in view of their activity as GITR agonists, the antigen binding proteins that are provided have value in a variety of immunotherapies in which it is desirable to induce or enhance a subject's immune response, such as in the treatment of a variety of cancers, immune disorders and infections.

The antigen binding proteins that are disclosed herein have a variety of additional utilities. The antigen binding proteins, for instance, are useful in specific binding assays, affinity purification of GITR, and in screening assays to identify other agonists of GITR activity. Other uses for the antigen binding proteins include, for example, diagnosis of GITR-associated diseases or conditions and screening assays to determine the presence or absence of GITR.

III. GITR Antigen Binding Proteins

Although the Examples included herein describe antigen binding proteins that are antibodies, the antigen binding proteins that are provided herein are not limited only to antibodies. In general, the antigen binding proteins that are provided herein comprise a scaffold, such as a polypeptide or polypeptides, into which one or more (e.g., 1, 2, 3, 4, 5 or 6) complementarity determining regions (CDRs), as described herein, are embedded and/or joined. In some antigen binding proteins, the CDRs are embedded into a "framework" region, which orients the CDR(s) such that the proper antigen binding properties of the CDR(s) are achieved. Additional types of scaffolds into which the CDRs can be embedded are described further below.

Thus, in some antigen binding proteins, the CDR sequences are embedded in a protein scaffold or other biocompatible polymer. In other embodiments, the antigen binding proteins is an antibody or is derived from an antibody. Accordingly, examples of certain antigen binding proteins that are provided include, but are not limited to, monoclonal antibodies, bispecific antibodies, minibodies, domain antibodies such as Nanobodies®, synthetic antibodies (sometimes referred to herein as "antibody mimetics"), chimeric antibodies, humanized antibodies, human antibodies, antibody fusions (sometimes referred to as "antibody conjugates"), and portions or fragments of each, respectively. In some instances, the antigen binding protein is an immunologically functional fragment of a complete antibody (e.g., a Fab, a Fab', a F(ab')$_2$, a scFv, a domain antibody or a minibody). The various structures are further described and defined herein.

Given their ability to activate GITR, the antigen binding proteins that are provided can exhibit one or more (e.g, 1, 2, 3, 4, 5, 6, 7, 8, 9, or 10) of the following biological activities in any combination:
   a. induce or enhance GITR signaling in vitro or in vivo;
   b. cross-compete with GITRL for binding to GITR;
   c. can be internalized into human CD4 cells;
   d. reduce regulatory T cell suppression of effector T cell activity;
   e. decrease levels of circulating regulatory T cells in vitro or in vivo;
   f. activate effector T cells in vitro or in vivo;
   g. induce or enhance effector T cell proliferation in vitro or in vivo;
   h. has a half life of at least 6, 7, 9 or 12 days in human serum
   i. inhibit tumor growth; and
   j. induce tumor regression.

A. GITR Antigen Binding Proteins with Naturally Occurring Antibody Structure

Some of the antigen binding proteins that are provided have the structure typically associated with naturally-occurring antibodies. The structural units of these antibodies typically comprise one or more tetramers, each composed of two identical couplets of polypeptide chains, though some species of mammals also produce antibodies having only a single heavy chain. In a typical antibody, each pair or couplet includes one full-length "light" chain (in certain embodiments, about 25 kDa) and one full-length "heavy" chain (in certain embodiments, about 50-70 kDa). Each individual immunoglobulin chain is composed of several "immunoglobulin domains", each consisting of roughly 90 to 110 amino acids and expressing a characteristic folding pattern. These domains are the basic units of which antibody polypeptides are composed. The amino-terminal portion of each chain typically includes a variable domain that is responsible for antigen recognition. The variable domain from the heavy chain as referred to herein is sometimes referred to simply as VH. Similarly, the variable domain from the light chain is referred to as VL. The carboxy-terminal portion is more conserved evolutionarily than the other end of the chain and is referred to as the "constant region" or "C region". Human light chains generally are classified as kappa and lambda light chains, and each of these contains one variable domain and one constant domain. Heavy chains are typically classified as mu, delta, gamma, alpha, or epsilon chains, and these define the antibody's isotype as IgM, IgD, IgG, IgA, and IgE, respectively. IgG has several subtypes, including, but not limited to, IgG1, IgG2, IgG3, and IgG4. IgM subtypes include IgM, and IgM2. IgA subtypes include IgA1 and IgA2. In humans, the IgA and IgD isotypes contain four heavy chains and four light chains; the IgG and IgE isotypes contain two heavy chains and two light chains; and the IgM isotype contains five heavy chains and five light chains. The heavy chain C region typically comprises one or more domains that may be responsible for effector function. The number of heavy chain constant region domains will depend on the isotype. IgG heavy chains, for example, each contain three C region domains known as $C_H1$, $C_H2$ and $C_H3$. The antibodies that are provided can have any of these isotypes and subtypes. In certain embodiments, the GITR antibody is of the IgG1, IgG2, or IgG4 subtype.

In full-length light and heavy chains, the variable and constant regions are joined by a "J" region of about twelve or more amino acids, with the heavy chain also including a "D" region of about ten more amino acids. See, e.g. Fundamental Immunology, 2nd ed., Ch. 7 (Paul, W., ed.) 1989, New York: Raven Press (hereby incorporated by reference in its entirety for all purposes). The variable regions of each light/heavy chain pair typically form the antigen binding site.

One example of an IgG1 heavy constant domain of an exemplary GITR monoclonal antibody has the amino acid sequence:

```
                                         (SEQ. ID NO: 442)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK*;
asterisk corresponds to stop codon).
```

One example of a lambda light chain constant domain of an exemplary GITR monoclonal antibody has the amino acid sequence:

```
                                         (SEQ ID NO: 443)
QPKAAPSVTLFPPSSEELQANKATLVCLISDFYPGAVTVAWKADSSPVK

AGVETTTPSKQSNNKYAASSYLSLTPEQWKSHRSYSCQVTHEGSTVEKT

VAPTECS*;
asterisk corresponds to stop codon).
```

An example of a kappa light chain constant domain of an exemplary GITR monoclonal antibody has the amino acid sequence:

```
                                         (SEQ ID NO: 444)
TVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVT

KSFNRGEC*;
asterisk corresponds to stop codon).
```

For the antibodies provided herein, the variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically to a specific epitope on GITR. From N-terminal to C-terminal, naturally-occurring light and heavy chain variable regions both typically conform to the following order of these elements: FR1, CDR1, FR2, CDR2, FR3, CDR3 and FR4. The CDRs from the heavy chain are typically referred to herein as CDRH1, CDRH2 and CDRH3. Likewise, the CDRs from the light chain are typically referred to herein as CDRL1, CDRL2 and CDRL3. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, J. Mol. Biol. 196:901-917; Chothia et al., 1989, Nature 342: 878-883.

The sequence information for the specific fully human monoclonal antibodies prepared as described in the Examples are summarized in TABLE 1. This table lists the six CDRs, the heavy chain variable domain (VH), the light chain variable domain (VL), the full length heavy chain (HC) and the full length light chain (LC) for each antibody. TABLE 1 includes sequence information for the selected parental antibodies, as well as engineered variants of the parental antibodies obtained through protein engineering. Alignments of the sequences are provided in FIGS. 8A, 8B, 9A, 9B, 10A, 10B, 11A and 11B.

TABLE 1

Sequences of Exemplary Antigen Binding Proteins

| ID No. | Ref. No. | Ab Name | HC SEQ ID NO: | LC SEQ ID NO: | VH SEQ ID NO: | VL SEQ ID NO: | CDRH1 SEQ ID NO: | CDRH2 SEQ ID NO: | CDRH3 SEQ ID NO: | CDRL1 SEQ ID NO: | CDRL2 SEQ ID NO: | CDRL3 SEQ ID NO: |
|---|---|---|---|---|---|---|---|---|---|---|---|---|
| Ab1 | SS-10942 | 1D7 | 335 | 316 | 137 | 118 | 31 | 36 | 46 | 5 | 11 | 18 |
| Ab2 | SS-12413 | 33C9 | 336 | 317 | 138 | 119 | 31 | 36 | 47 | 5 | 11 | 19 |
| Ab3 | SS-12414 | 33F6 | 337 | 318 | 139 | 120 | 32 | 37 | 48 | 5 | 12 | 20 |
| Ab4 | SS-12415 | 34G4 | 338 | 319 | 140 | 121 | 31 | 36 | 49 | 5 | 11 | 20 |
| Ab5 | SS-12416 | 35B10 | 339 | 320 | 141 | 122 | 31 | 38 | 50 | 5 | 13 | 18 |
| Ab6 | SS-12417 | 41E11 | 340 | 321 | 142 | 123 | 33 | 39 | 51 | 6 | 12 | 21 |
| Ab7 | SS-12428 | 41G5 | 341 | 322 | 143 | 124 | 31 | 40 | 52 | 5 | 12 | 18 |
| Ab8 | SS-12418 | 42A11 | 342 | 323 | 144 | 125 | 31 | 36 | 53 | 5 | 11 | 18 |
| Ab9 | SS-12419 | 44C1 | 343 | 324 | 145 | 126 | 31 | 41 | 54 | 7 | 15 | 22 |
| Ab10 | SS-12420 | 45A8 | 344 | 325 | 146 | 127 | 31 | 42 | 55 | 7 | 15 | 23 |
| Ab11 | SS-12421 | 46E11 | 345 | 326 | 147 | 128 | 31 | 38 | 56 | 5 | 12 | 24 |
| Ab12 | SS-12422 | 48H12 | 346 | 327 | 148 | 129 | 31 | 38 | 57 | 5 | 12 | 18 |
| Ab13 | SS-12423 | 48H7 | 347 | 328 | 149 | 130 | 33 | 36 | 58 | 6 | 12 | 25 |
| Ab14 | SS-12424 | 49D9 | 348 | 329 | 150 | 131 | 31 | 38 | 59 | 5 | 12 | 20 |
| Ab15 | SS-12425 | 49E2 | 349 | 330 | 151 | 132 | 31 | 43 | 60 | 8 | 15 | 26 |
| Ab16 | SS-12427 | 48A9 | 350 | 331 | 152 | 133 | 34 | 44 | 61 | 9 | 16 | 27 |
| Ab17 | SS-10943 | 5H7 | 351 | 332 | 153 | 134 | 35 | 45 | 62 | 10 | 17 | 28 |
| Ab18 | SS-10944 | 7A10 | 352 | 333 | 154 | 135 | 31 | 37 | 58 | 5 | 12 | 29 |
| Ab19 | SS-10945 | 9H6 | 353 | 334 | 155 | 136 | 3 | 36 | 63 | 5 | 14 | 30 |
| Ab20 | SS-12514 | 44C1v1 | 394 | 354 | 276 | 236 | 31 | 41 | 54 | 64 | 15 | 65 |
| Ab21 | SS-12515 | 45A8v1 | 395 | 355 | 277 | 237 | 31 | 42 | 55 | 64 | 15 | 66 |
| Ab22 | SS-12562 | 49D9v1 | 396 | 356 | 278 | 238 | 31 | 38 | 59 | 5 | 12 | 20 |
| Ab23 | SS-12516 | 49E2v1 | 397 | 357 | 279 | 239 | 31 | 43 | 60 | 8 | 15 | 434 |
| Ab24 | SS-12513 | 48A9v1 | 398 | 358 | 280 | 240 | 31 | 44 | 61 | 9 | 16 | 27 |
| Ab25 | SS-16912 | 5H7v1 | 399 | 359 | 281 | 241 | 35 | 45 | 75 | 10 | 17 | 28 |
| Ab26 | SS-13807 | 5H7v2 | 400 | 360 | 282 | 242 | 35 | 45 | 76 | 10 | 17 | 28 |
| Ab27 | SS-16913 | 5H7v3 | 401 | 361 | 283 | 243 | 35 | 45 | 77 | 10 | 17 | 28 |
| Ab28 | SS-16915 | 5H7v5 | 402 | 362 | 284 | 244 | 35 | 45 | 78 | 10 | 17 | 28 |
| Ab29 | SS-16917 | 5H7v7 | 403 | 363 | 285 | 245 | 35 | 45 | 79 | 10 | 17 | 28 |
| Ab30 | SS-16921 | 5H7v9 | 404 | 364 | 286 | 246 | 35 | 45 | 62 | 10 | 17 | 28 |
| Ab31 | SS-16919 | 5H7v10 | 405 | 365 | 287 | 247 | 35 | 45 | 62 | 10 | 17 | 67 |
| Ab32 | SS-16920 | 5H7v11 | 406 | 366 | 288 | 248 | 35 | 45 | 62 | 10 | 17 | 68 |
| Ab33 | SS-16923 | 5H7v13 | 407 | 367 | 289 | 249 | 35 | 45 | 76 | 10 | 17 | 67 |
| Ab34 | SS-16924 | 5H7v14 | 408 | 368 | 290 | 250 | 35 | 45 | 77 | 10 | 17 | 67 |
| Ab35 | SS-16927 | 5H7v17 | 409 | 369 | 291 | 251 | 35 | 45 | 76 | 10 | 17 | 68 |
| Ab36 | SS-16928 | 5H7v18 | 410 | 370 | 292 | 252 | 35 | 45 | 77 | 10 | 17 | 68 |
| Ab37 | SS-16929 | 5H7v19 | 411 | 371 | 293 | 253 | 35 | 45 | 435 | 10 | 17 | 68 |
| Ab38 | SS-16932 | 5H7v22 | 412 | 372 | 294 | 254 | 35 | 45 | 79 | 10 | 17 | 67 |
| Ab39 | SS-13810 | 7A10v1 | 413 | 373 | 295 | 255 | 31 | 37 | 58 | 5 | 12 | 29 |
| Ab40 | SS-16938 | 7A10v2 | 414 | 374 | 296 | 256 | 31 | 37 | 58 | 5 | 12 | 29 |
| Ab41 | SS-16939 | 7A10v3 | 415 | 375 | 297 | 257 | 31 | 69 | 58 | 5 | 12 | 29 |
| Ab42 | SS-16940 | 7A10v4 | 416 | 376 | 298 | 258 | 31 | 70 | 58 | 5 | 12 | 29 |
| Ab43 | SS-16941 | 7A10v5 | 417 | 377 | 299 | 259 | 31 | 69 | 58 | 5 | 12 | 29 |
| Ab44 | SS-16943 | 9H6v1 | 418 | 378 | 300 | 260 | 31 | 36 | 63 | 5 | 14 | 30 |
| Ab45 | SS-16944 | 9H6v2 | 419 | 379 | 301 | 261 | 31 | 36 | 63 | 5 | 14 | 30 |
| Ab46 | SS-13806 | 9H6v3 | 420 | 380 | 302 | 262 | 31 | 71 | 63 | 5 | 14 | 30 |
| Ab47 | SS-16945 | 9H6v4 | 421 | 381 | 303 | 263 | 31 | 72 | 63 | 5 | 14 | 30 |
| Ab48 | SS-16946 | 9H6v5 | 422 | 382 | 304 | 264 | 31 | 71 | 63 | 5 | 14 | 30 |
| Ab49 | SS-16947 | 9H6v6 | 423 | 383 | 305 | 265 | 31 | 72 | 63 | 5 | 14 | 30 |
| Ab50 | SS-16948 | 33C9v1 | 424 | 384 | 306 | 266 | 31 | 36 | 47 | 5 | 11 | 19 |
| Ab51 | SS-13808 | 33C9v2 | 425 | 385 | 307 | 267 | 31 | 71 | 47 | 5 | 11 | 19 |
| Ab52 | SS-16949 | 33C9v3 | 426 | 386 | 308 | 268 | 31 | 72 | 47 | 5 | 11 | 19 |
| Ab53 | SS-16950 | 33C9v4 | 427 | 387 | 309 | 269 | 31 | 71 | 47 | 5 | 11 | 19 |
| Ab54 | SS-16951 | 33C9v5 | 428 | 388 | 310 | 270 | 31 | 72 | 47 | 5 | 11 | 19 |
| Ab55 | SS-16952 | 41G5v1 | 429 | 389 | 311 | 271 | 31 | 40 | 52 | 5 | 12 | 18 |
| Ab56 | SS-13809 | 41G5v2 | 430 | 390 | 312 | 272 | 31 | 73 | 52 | 5 | 12 | 18 |
| Ab57 | SS-16953 | 41G5v3 | 431 | 391 | 313 | 273 | 31 | 74 | 52 | 5 | 12 | 18 |
| Ab58 | SS-16954 | 41G5v4 | 432 | 392 | 314 | 274 | 31 | 73 | 52 | 5 | 12 | 18 |
| Ab59 | SS-16955 | 41G5v5 | 433 | 393 | 315 | 275 | 31 | 74 | 52 | 5 | 12 | 18 |

In general, the antigen binding proteins that are provided include one or more CDRs, one or more variable domains, and/or one or more full length heavy or light chain sequences of an antibody as listed in TABLE 1, as well as variants or derivatives of such sequences.

B. GITR Antigen Binding Proteins—CDRs

For example, in one embodiment, the antigen binding protein comprises a scaffold into which one or more CDRs are grafted, inserted and/or joined. In certain embodiments, the scaffold is a polypeptide. For example, the CDRs can be part of an antibody having the naturally-occurring structure described above. Additional examples of scaffolds include, but are not limited to, fibronectin, neocarzinostatin CBM4-2, lipocalins, protein-A domain (protein Z), Im9, TPR proteins, zinc finger domains, pVIII, GC4, transferrin, and C-type lectin-like domains. Further scaffolds that can be used in certain embodiments are described in Gebauer and Skerra (2009) Curr. Opin. Chem. Biol., 13:245-255, and Binz et al. (2005) Nat. Biotech. 23:1257-1268, both of which are incorporated herein by reference in their entirety.

An antigen binding protein can have 1, 2, 3, 4, 5 or 6 CDRs. An antigen binding protein thus can have, for example, one heavy chain CDR1 ("CDRH1"), and/or one heavy chain CDR2 ("CDRH2"), and/or one heavy chain CDR3 ("CDRH3"), and/or one light chain CDR1 ("CDRL1"), and/or one light chain CDR2 ("CDRL2"), and/or one light chain CDR3 ("CDRL3") selected from the CDR sequences listed in TABLE 1.

Some antigen binding proteins include both a CDRH3 and a CDRL3, each of which are from the same antibody listed in TABLE 1.

Some antigen binding proteins comprise a CDRL1, a CDRL2 and a CDRL3, each from the same variable light chain of any single antibody selected from the group Ab1 to Ab59 inclusive. In another embodiment, the antigen binding protein comprises a CDRL1, a CDRL2, and a CDRL3, each from the same antibody as listed in TABLE 1, wherein the amino acid sequence of each of CDRL1, CDRL2 and CDRL3 is as specified in TABLE 1 for that antibody.

In another embodiment, the antigen binding protein comprises a CDRL1, a CDRL2 and a CDRL3, wherein one or more of CDRL1, CDRL2 and CDRL3 differ in sequence relative to the corresponding CDRL1, CDRL2 and CDRL3 of the variable domain of any single antibody selected from the group of Ab1 to Ab59, provided, however, that the sequence differences collectively total no more than 1, 2, 3 or 4 amino acid differences.

Other antigen binding proteins comprise a CDRH1, a CDRH2 and a CDRH3, each from the same variable heavy chain of any single antibody selected from the group of Ab1 to Ab59 inclusive. In another embodiment, the antigen binding protein comprises a CDRH1, a CDRH2, and a CDRH3, each from the same antibody as listed in TABLE 1, wherein the amino acid sequence of each of CDRH1, CDRH2 and CDRH3 is as specified in TABLE 1 for that antibody.

In still another embodiment, the antigen binding protein comprises a CDRH1, a CDRH2 and a CDRH3, wherein one or more of CDRH1, CDRH2 and CDRH3 differ in sequence relative to the corresponding CDRH1, CDRH2 and CDRH3 of the variable domain of any single antibody selected from the group of Ab1 to Ab59 inclusive, provided however that the sequence differences collectively total no more than 1, 2, 3 or 4 amino acid differences.

Still other antigen binding proteins comprise all six CDRs of any single antibody selected from the group Ab1 to Ab59 inclusive. In still another embodiment, the antigen binding protein comprises all six CDRs for any single antibody selected from the group Ab1 to Ab59 inclusive, wherein the six CDRs each comprise the amino acid sequence as listed in TABLE 1.

Other antigen binding proteins comprise all six CDRs of any single antibody as selected from the group Ab1 to Ab59 inclusive, except that one or more of CDRL1, CDRL2, CDRL3, CDRH1, CDRH2 and CDRH3 differ in sequence relative to the corresponding CDRL1, CDRL2, CDRL3, CDRH1, CDRH2 and CDRH3 of the selected antibody, provided however that the sequence differences collectively total no more than 1, 2, 3, 4, 5, or 6 amino acid differences.

C. GITR Antigen Binding Proteins—Variable Domains

Antigen binding proteins comprising a light chain variable domain (VL) of any antibody selected from the group Ab1 to Ab59 inclusive are also provided. In another embodiment, the antigen binding protein comprises a VL of any antibody selected from the group Ab1 to Ab59 inclusive, wherein the amino acid sequence of the VL is as specified in TABLE 1.

In another embodiment, the antigen binding protein comprises a variant VL sequence that is at least 80%, 85%, 90%, 95%, 97% or 99% identical in amino acid sequence to the VL sequence of any one of antigen binding proteins Ab1 to Ab59 inclusive as specified in TABLE 1.

Other antigen binding proteins comprise a variant VL sequence that differs from the amino acid sequence of a VL from any one of the antigen binding proteins Ab1 to Ab59 inclusive as specified in TABLE 1 by no more than 1, 2, 3, 4, 5, 6, 7, 8, 9, or 10 amino acids. In another aspect, the variant VL sequence differs by no more than 1, 2, 3, 4 or 5 amino acids.

Some antigen binding proteins comprise a heavy chain variable domain (VH) of any antibody selected from the group Ab1 to Ab59 inclusive. In another embodiment, the antigen binding protein comprises a VH of any antibody selected from the group Ab1 to Ab59 inclusive as specified in TABLE 1, wherein the amino acid sequence of the VH is as specified in TABLE 1.

In another embodiment, the antigen binding protein comprises a variant VH sequence that is at least 80%, 85%, 90%, 95%, 97% or 99% identical in amino acid sequence to the VH sequence of any one of antigen binding proteins Ab1 to Ab59 inclusive.

Other antigen binding proteins comprise a variant VH sequence that differs from the amino acid sequence of a VH from any one of the antigen binding proteins Ab1 to Ab59 inclusive as specified in TABLE 1 by no more than 1, 2, 3, 4, 5, 6, 7, 8, 9, or 10 amino acids. In another aspect, the variant VH sequence differs by no more than 1, 2, 3, 4 or 5 amino acids.

Still other antigen antigen binding proteins comprise a VL and a VH, each from the same antibody selected from the group consisting of Ab1 to Ab59 inclusive. In another embodiment, the antigen binding protein comprises a VL and a VH from the same antibody selected from the group consisting of Ab1 to Ab59 inclusive, wherein the amino acid sequences of the VL and VH are as specified in TABLE 1.

In another aspect an antigen binding protein comprises a VL and a VH, each from the same antibody selected from the group Ab1 to Ab59, in which one or both of the VL and VH is at least 80%, 85%, 90%, 95%, 97% or 99% identical in amino acid sequence to the VL or VH sequence, respectively, of any one of antigen binding proteins Ab1 to Ab59 inclusive.

Some antigen binding proteins comprise a variant VL and/or a variant VH, in which one or both of the variant VL and variant VH differ from the respective VL or VH sequence of any single antibody selected from the group of Ab1 to Ab59 inclusive, provided the sequence differences in the VH and VL collectively total no more than 1, 2, 3, 4, 5, 6, 7, 8, 9, or 10 amino acids. In another embodiment, the differences total no more than 1, 2, 3, 4 or 5 amino acids.

In still another embodiment, the antigen binding protein comprises a VH and a VL from the same antibody selected from the group of Ab1 to Ab59 inclusive, except that 1, 2, 3 or 4 amino acids are missing from the N-terminal end of the VH and/or VL sequence. Such alterations may happen, for instance, due to cleavage during expression or storage.

D. GITR Antigen Binding Proteins—Full Length Sequences

Antigen binding proteins comprising a full length heavy chain that comprises the amino acid sequence of the full length heavy chain of any one of the antibodies as specified in TABLE 1 are also provided.

Other antigen binding proteins comprise a full length light chain comprising the amino acid sequence of the full length light chain of any one of the antibodies as specified in TABLE 1.

Thus, in one embodiment, the antigen binding protein is an antibody and comprises a full length heavy chain and full length light chain, each obtained from the same antibody as listed in TABLE 1. In another embodiment, the antibody contains two identical light chains and two identical heavy chains, each obtained from the same antibody as listed in TABLE 1.

Sill other antigen binding proteins are variants of any single antibody shown in TABLE 1 in which the full length light and/or full length heavy chain of the variant antibody has an amino acid sequence that is at least 80%, 85%, 90%, 95%, 97% or 99% identical to the amino acid sequences of the light and heavy chain of the corresponding antibody listed in TABLE 1. Thus, in one embodiment, the antigen binding protein includes a full length light chain that has an amino acid sequence at least 80%, 85%, 90%, 95%, 97% or 99% identical to the amino acid sequence of the light chain of an antibody listed in TABLE 1. In another aspect, the antigen binding protein includes a full length heavy chain that has an amino acid sequence at least 80%, 85%, 90%, 95%, 97% or 99% identical to the amino acid sequence of the heavy chain of an antibody listed in TABLE 1.

Other variants of the antibodies shown in TABLE 1, are provided that comprise a full length light chain and a full length heavy chain as listed for a single antibody listed in TABLE 1, except that the sequence of one or both of the chains differs from the corresponding sequence specified in the TABLE 1 by no more than 1, 2, 3, 4, 5, 6, 7, 8, 9, 10, 11, 12, 13, 14 or 15 amino acid residues.

In still another aspect, an antigen-binding protein containing the CDRs, variable domains and/or full length sequences listed in TABLE 1 is a monoclonal antibody, a chimeric antibody, a humanized antibody, a human antibody, a multispecific antibody, or an antibody fragment of the foregoing. In another embodiment, the antibody fragment of the isolated antigen-binding proteins provided herein is a Fab fragment, a Fab' fragment, an F(ab')$_2$ fragment, an Fv fragment, a diabody, or a single chain antibody molecule based upon an antibody with the sequences as listed in TABLE 1.

In a further embodiment, the isolated antigen binding protein provided herein is a human antibody with the sequences as set forth in TABLE 1 and is of the IgG1-, IgG2-IgG3- or IgG4-type. In certain embodiments, the antibody is of the IgG1 type.

Certain antigen binding proteins comprise the CDR, variable domain and/or full length sequences as specified for any single antibody selected from the group of Ab1 to Ab59 inclusive of TABLE 1 and are further characterized in having one or more of the following characteristics:
(a) binds human GITR such that $K_D$ is ≤300 nM, is ≤150 nM, is ≤100 nM, is ≤75 nM, is ≤50 nM, is ≤10 nM, is ≤5 nM, is ≤2 nM, or is ≤1 nM;
(b) has a half-life in human serum of at least 6, 7, 9 or 12 days;
(c) binds human GITR of SEQ ID NO:1 and cyno GITR of SEQ ID NO:2;
(c) binds human GITR of SEQ ID NO:1 with $K_D$≤10 nM and binds cyno GITR of SEQ ID NO:2 with $K_D$≤500 nM;
(d) binds human GITR of SEQ ID NO:1 and cyno GITR of SEQ ID NO:2 but not mouse GITR of SEQ ID NO:3.

In some embodiments, the antigen binding protein has an on-rate ($k_a$) for GITR of at least $10^4$/M×seconds, at least $10^5$/M×seconds, or at least $10^6$/M×seconds measured, for instance, as described in the examples below. Certain antigen binding proteins that are provided have a slow dissociation rate or off-rate. Some antigen binding proteins, for instance, have a $k_d$ (off-rate) of $1×10^{-2}$ s$^{-1}$, or $1×10^{-3}$ s$^{-1}$, or $1×10^{-4}$ s$^{-1}$, or $1×10^{-5}$ s$^{-1}$. In certain embodiments, the antigen binding protein has a $K_D$ (equilibrium binding affinity) of less than 25 pM, 50 pM, 100 pM, 500 pM, 1 nM, 5 nM, 10 nM, 25 nM or 50 nM.

In another aspect, an antigen-binding protein is provided having a half-life of at least one day in vitro or in vivo (e.g., when administered to a human subject). In one embodiment, the antigen binding protein has a half-life of at least three days. In various other embodiments, the antigen binding protein has a half-life of 4, 5, 6, 7, 8, 9, 10, 15, 20, 25, 30, 40, 50, or 60 days or longer. In another embodiment, the antigen binding protein is derivatized or modified such that it has a longer half-life as compared to the underivatized or unmodified antibody. In another embodiment, the antigen binding protein contains point mutations to increase serum half life. Further details regarding such mutant and derivatized forms are provided below.

E. GITR Antigen Binding Proteins—Consensus Sequences

In yet another aspect, antigen binding proteins are provided that comprise CDRs with consensus amino acid sequences derived from groups of related antibodies as disclosed herein. As described herein, a "consensus sequence" refers to amino acid sequences having conserved amino acids common among a number of sequences and variable amino acids that vary within a given set of amino acid sequences. The CDR consensus sequences provided include CDRs corresponding to each of CDRH1, CDRH2, CDRH3, CDRL1, CDRL2 and CDRL3.

In one embodiment, the consensus sequences are derived from the CDRs of Abs 1-8, 11-14 and 18-19 as summarized in TABLE 1 and the Figures.

Thus, in an embodiment, an antigen binding protein comprises a VH that itself comprises a CDRH1, a CDRH2 and a CDRH3, wherein
CDRH1 comprises the sequence X$_1$YGMX$_2$ (SEQ ID NO:436), wherein X1 is S or N; and X2 is H or Y;
CDRH2 comprises the sequence VIWYX$_1$GSNKYYADSVX$_2$G (SEQ ID NO:437), wherein X1 is E, V, A, P; and X2 is K or R;
CDRH3 comprises the sequence GGX$_1$LX$_2$X$_3$X$_4$YYX$_5$GMDV (SEQ ID NO:438), wherein X1 is Q, L, E, or R; X2 is G, R, or S; X3 is K, Y, L, F, or R; and X4 is Y or D; and X5 is Y or S;

In another embodiment, an antigen binding protein comprises a VL that itself comprises a CDRL1, a CDRL2 and a CDRL3, wherein
   CDRL1 comprises the sequence RASQX$_1$IRNDLG (SEQ ID NO:439), wherein X1 is G or V;
   CDRL2 comprises the sequence X$_1$X$_2$SX$_3$LQS (SEQ ID NO:440), wherein X1 is A or D; X2 is A or T; and X3 is S or T;
   CDRL3 comprises the sequence X$_1$QX$_2$X$_3$X$_4$YPX$_5$T (SEQ ID NO:441), wherein X1 is L or Q; X2 is H or L; X3 is N or H; X4 is S, N or T, and X5 is W, L or I.

In yet another embodiment, an antigen binding protein comprises a VH and a VL, each with their respective consensus CDR sequences as described above.

F. Competing Antigen Binding Proteins

In another embodiment, antigen binding proteins are provided that compete with one of the exemplified antibodies or functional fragments described above for specific binding to GITR (e.g., human GITR of SEQ ID NO:1). Such antigen binding proteins may bind to the same epitope as one of the antigen binding proteins described herein, or to an overlapping epitope. Antigen binding proteins and fragments that compete with the exemplified antigen binding proteins are expected to show similar functional properties. The exemplified antigen binding proteins and fragments include those described above, including those with the heavy and light chains, variable region domains and CDRs included in TABLE 1. Thus, as a specific example, the antigen binding proteins that are provided include those that compete with an antibody having:
   (a) all 6 of the CDRs listed for the same antibody listed in TABLE 1;
   (b) a VH and a VL listed for the same antibody listed in TABLE 1; or
   (c) two light chains and two heavy chains as specified for the same antibody listed in TABLE 1.

In an embodiment, competition is determined by a BIAcore assay.

G. Monoclonal Antibodies

The antigen binding proteins that are provided include monoclonal antibodies that bind to GITR. Monoclonal antibodies may be produced using any technique known in the art, e.g., by immortalizing spleen cells harvested from the transgenic animal after completion of the immunization schedule. The spleen cells can be immortalized using any technique known in the art, e.g., by fusing them with myeloma cells to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in mouse fusions include Sp-20, P3-X63/Ag8, P3-X63-Ag8.653, NS1/1.Ag 4 1, Sp210-Ag14, FO, NSO/U, MPC-11, MPC11-X45-GTG 1.7 and S194/5XXO Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

In some instances, a hybridoma cell line is produced by immunizing an animal (e.g., a transgenic animal having human immunoglobulin sequences) with a GITR protein immunogen; harvesting spleen cells from the immunized animal; fusing the harvested spleen cells to a myeloma cell line, thereby generating hybridoma cells; establishing hybridoma cell lines from the hybridoma cells, and identifying a hybridoma cell line that produces an antibody that binds an GITR polypeptide. Such hybridoma cell lines, and anti-GITR monoclonal antibodies produced by them, are aspects of the present application.

Monoclonal antibodies secreted by a hybridoma cell line can be purified using any technique known in the art. Hybridomas or mAbs may be further screened to identify mAbs with particular properties, such as the ability to induce or enhance GITR activity. Examples of such screens are provided in the Examples below.

H. Chimeric and Humanized Antibodies

Chimeric and humanized antibodies based upon the foregoing sequences are also provided. Monoclonal antibodies for use as therapeutic agents may be modified in various ways prior to use. One example is a chimeric antibody, which is an antibody composed of protein segments from different antibodies that are covalently joined to produce functional immunoglobulin light or heavy chains or immunologically functional portions thereof. Generally, a portion of the heavy chain and/or light chain is identical with or homologous to a corresponding sequence in antibodies derived from a particular species or belonging to a particular antibody class or subclass, while the remainder of the chain(s) is/are identical with or homologous to a corresponding sequence in antibodies derived from another species or belonging to another antibody class or subclass. For methods relating to chimeric antibodies, see, for example, U.S. Pat. No. 4,816,567; and Morrison et al., 1985, Proc. Natl. Acad. Sci. USA 81:6851-6855, which are hereby incorporated by reference. CDR grafting is described, for example, in U.S. Pat. No. 6,180,370, U.S. Pat. No. 5,693,762, U.S. Pat. No. 5,693,761, U.S. Pat. No. 5,585,089, and U.S. Pat. No. 5,530,101.

Generally, the goal of making a chimeric antibody is to create a chimera in which the number of amino acids from the intended patient species is maximized. One example is the "CDR-grafted" antibody, in which the antibody comprises one or more complementarity determining regions (CDRs) from a particular species or belonging to a particular antibody class or subclass, while the remainder of the antibody chain(s) is/are identical with or homologous to a corresponding sequence in antibodies derived from another species or belonging to another antibody class or subclass. For use in humans, the variable region or selected CDRs from a rodent antibody often are grafted into a human antibody, replacing the naturally-occurring variable regions or CDRs of the human antibody.

One useful type of chimeric antibody is a "humanized" antibody. Generally, a humanized antibody is produced from a monoclonal antibody raised initially in a non-human animal. Certain amino acid residues in this monoclonal antibody, typically from non-antigen recognizing portions of the antibody, are modified to be homologous to corresponding residues in a human antibody of corresponding isotype. Humanization can be performed, for example, using various methods by substituting at least a portion of a rodent variable region for the corresponding regions of a human antibody (see, e.g., U.S. Pat. No. 5,585,089, and U.S. Pat. No. 5,693,762; Jones et al., 1986, Nature 321:522-525; Riechmann et al., 1988, Nature 332:323-27; Verhoeyen et al., 1988, Science 239:1534-1536).

In one aspect, the CDRs of the light and heavy chain variable regions of the antibodies provided herein (see, TABLE 1) are grafted to framework regions (FRs) from antibodies from the same, or a different, phylogenetic species. To create consensus human FRs, FRs from several human heavy chain or light chain amino acid sequences may be aligned to identify a consensus amino acid sequence. In other embodiments, the FRs of a heavy chain or light chain disclosed herein are replaced with the FRs from a different heavy chain or light chain. In one aspect, rare amino acids in the FRs of the heavy and light chains of GITR antibodies are not replaced, while the rest of the FR amino acids are replaced. A "rare amino acid" is a specific amino acid that is in a position in which this particular amino acid is not usually found in an FR. Alternatively, the grafted variable regions from the one heavy or light chain may be used with a constant region that is different from the constant region of that particular heavy or light chain as disclosed herein. In other embodiments, the grafted variable regions are part of a single chain Fv antibody.

In certain embodiments, constant regions from species other than human can be used along with the human variable region(s) to produce hybrid antibodies.

I. Fully Human Antibodies

Fully human GITR antibodies are also provided. Methods are available for making fully human antibodies specific for a given antigen without exposing human beings to the antigen ("fully human antibodies"). One specific means provided for implementing the production of fully human antibodies is the "humanization" of the mouse humoral immune system. Introduction of human immunoglobulin (Ig) loci into mice in which the endogenous Ig genes have been inactivated is one means of producing fully human monoclonal antibodies (mAbs) in mouse, an animal that can be immunized with any desirable antigen. Using fully human antibodies can minimize the immunogenic and allergic responses that can sometimes be caused by administering mouse or mouse-derived mAbs to humans as therapeutic agents.

Fully human antibodies can be produced by immunizing transgenic animals (usually mice) that are capable of producing a repertoire of human antibodies in the absence of endogenous immunoglobulin production. Antigens for this purpose typically have six or more contiguous amino acids, and optionally are conjugated to a carrier, such as a hapten. See, e.g., Jakobovits et al., 1993, Proc. Natl. Acad. Sci. USA 90:2551-2555; Jakobovits et al., 1993, Nature 362:255-258; and Bruggermann et al., 1993, Year in Immunol. 7:33. In one example of such a method, transgenic animals are produced by incapacitating the endogenous mouse immunoglobulin loci encoding the mouse heavy and light immunoglobulin chains therein, and inserting into the mouse genome large fragments of human genome DNA containing loci that encode human heavy and light chain proteins. Partially modified animals, which have less than the full complement of human immunoglobulin loci, are then cross-bred to obtain an animal having all of the desired immune system modifications. When administered an immunogen, these transgenic animals produce antibodies that are immunospecific for the immunogen but have human rather than murine amino acid sequences, including the variable regions. For further details of such methods, see, for example, WO96/33735 and WO94/02602. Additional methods relating to transgenic mice for making human antibodies are described in U.S. Pat. No. 5,545,807; U.S. Pat. No. 6,713,610; U.S. Pat. No. 6,673,986; U.S. Pat. No. 6,162,963; U.S. Pat. No. 5,545,807; U.S. Pat. No. 6,300,129; U.S. Pat. No. 6,255,458; U.S. Pat. No. 5,877,397; U.S. Pat. No. 5,874,299 and U.S. Pat. No. 5,545,806; in PCT publications WO91/10741, WO90/04036, and in EP 546073B1 and EP 546073A1.

The transgenic mice described above, referred to herein as "HuMab" mice, contain a human immunoglobulin gene minilocus that encodes unrearranged human heavy ([mu] and [gamma]) and [kappa] light chain immunoglobulin sequences, together with targeted mutations that inactivate the endogenous [mu] and [kappa] chain loci (Lonberg et al., 1994, Nature 368:856-859). Accordingly, the mice exhibit reduced expression of mouse IgM or [kappa] and in response to immunization, and the introduced human heavy and light chain transgenes undergo class switching and somatic mutation to generate high affinity human IgG [kappa] monoclonal antibodies (Lonberg et al., supra.; Lonberg and Huszar, 1995, Intern. Rev. Immunol. 13: 65-93; Harding and Lonberg, 1995, Ann. N.Y Acad. Sci. 764:536-546). The preparation of HuMab mice is described in detail in Taylor et al., 1992, Nucleic Acids Research 20:6287-6295; Chen et al., 1993, International Immunology 5:647-656; Tuaillon et al., 1994, J. Immunol. 152:2912-2920; Lonberg et al., 1994, Nature 368:856-859; Lonberg, 1994, Handbook of Exp. Pharmacology 113:49-101; Taylor et al., 1994, International Immunology 6:579-591; Lonberg and Huszar, 1995, Intern. Rev. Immunol. 13:65-93; Harding and Lonberg, 1995, Ann. N.Y Acad. Sci. 764:536-546; Fishwild et al., 1996, Nature Biotechnology 14:845-851; the foregoing references are hereby incorporated by reference in their entirety for all purposes. See, further U.S. Pat. No. 5,545,806; U.S. Pat. No. 5,569,825; U.S. Pat. No. 5,625,126; U.S. Pat. No. 5,633,425; U.S. Pat. No. 5,789,650; U.S. Pat. No. 5,877,397; U.S. Pat. No. 5,661,016; U.S. Pat. No. 5,814,318; U.S. Pat. No. 5,874,299; and U.S. Pat. No. 5,770,429; as well as U.S. Pat. No. 5,545,807; International Publication Nos. WO 93/1227; WO 92/22646; and WO 92/03918, the disclosures of all of which are hereby incorporated by reference in their entirety for all purposes. Technologies utilized for producing human antibodies in these transgenic mice are disclosed also in WO 98/24893, and Mendez et al., 1997, Nature Genetics 15:146-156, which are hereby incorporated by reference. For example, the HCo7 and HCo12 transgenic mice strains can be used to generate anti-GITR antibodies. Further details regarding the production of human antibodies using transgenic mice are provided in the Examples below.

Using hybridoma technology, antigen-specific human mAbs with the desired specificity can be produced and selected from the transgenic mice such as those described above. Such antibodies may be cloned and expressed using a suitable vector and host cell, or the antibodies can be harvested from cultured hybridoma cells.

Fully human antibodies can also be derived from phage-display libraries (as disclosed in Hoogenboom et al., 1991, J. Mol. Biol. 227:381; and Marks et al., 1991, J. Mol. Biol. 222:581). Phage display techniques mimic immune selection through the display of antibody repertoires on the surface of filamentous bacteriophage, and subsequent selection of phage by their binding to an antigen of choice. One such technique is described in PCT Publication No. WO 99/10494 (hereby incorporated by reference).

TABLE 1 includes sequence information for a number of fully human antigen binding proteins such as are provided herein.

J. Bispecific or Bifunctional Antigen Binding Proteins

The antigen binding proteins that are provided also include bispecific and bifunctional antibodies that include one or more CDRs or one or more variable regions as described above. A bispecific or bifunctional antibody in some instances is an artificial hybrid antibody having two different heavy/light chain pairs and two different binding sites. Bispecific antibodies may be produced by a variety of methods including, but not limited to, fusion of hybridomas or linking of Fab' fragments. See, e.g., Songsivilai and Lachmann, 1990, Clin. Exp. Immunol. 79:315-321; Kostelny et al., 1992, J. Immunol. 148:1547-1553.

K. Variants

In one embodiment, for instance, an antigen binding protein is a variant form of the antigen binding proteins disclosed above (e.g., those having the sequences listed in TABLE 1). For instance, some of the antigen binding proteins have one or more conservative amino acid substitutions in one or more of the heavy or light chains, variable regions or CDRs listed in TABLE 1.

Naturally-occurring amino acids may be divided into classes based on common side chain properties:

1) hydrophobic: norleucine, Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties.

Non-conservative substitutions may involve the exchange of a member of one of the above classes for a member from another class. Such substituted residues may be introduced into regions of the antibody that are homologous with human antibodies, or into the non-homologous regions of the molecule.

In making such changes, according to certain embodiments, the hydropathic index of amino acids may be considered. The hydropathic profile of a protein is calculated by assigning each amino acid a numerical value ("hydropathy index") and then repetitively averaging these values along the peptide chain. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic profile in conferring interactive biological function on a protein is understood in the art (see, e.g., Kyte et al., 1982, *J. Mol. Biol.* 157:105-131). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In some aspects, those which are within ±1 are included, and in other aspects, those within ±0.5 are included.

It is also understood in the art that the substitution of like amino acids can be made effectively on the basis of hydrophilicity, particularly where the biologically functional protein or peptide thereby created is intended for use in immunological embodiments, as in the present case. In certain embodiments, the greatest local average hydrophilicity of a protein, as governed by the hydrophilicity of its adjacent amino acids, correlates with its immunogenicity and antigen-binding or immunogenicity, that is, with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in other embodiments, those which are within ±1 are included, and in still other embodiments, those within ±0.5 are included. In some instances, one may also identify epitopes from primary amino acid sequences on the basis of hydrophilicity. These regions are also referred to as "epitopic core regions."

Exemplary conservative amino acid substitutions are set forth in TABLE 2.

TABLE 2

Conservative Amino Acid Substitutions

| Original Residue | Exemplary Substitutions |
| --- | --- |
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

A skilled artisan will be able to determine suitable variants of polypeptides as set forth herein using well-known techniques. One skilled in the art may identify suitable areas of the molecule that may be changed without destroying activity by targeting regions not believed to be important for activity. The skilled artisan also will be able to identify residues and portions of the molecules that are conserved among similar polypeptides. In further embodiments, even areas that may be important for biological activity or for structure may be subject to conservative amino acid substitutions without destroying the biological activity or without adversely affecting the polypeptide structure.

Moreover, one skilled in the art may generate test variants containing a single amino acid substitution at each desired amino acid residue. These variants can then be screened using assays for GITR antigen binding proteins, (see examples below) thus yielding information regarding which amino acids can be changed and which must not be changed. In other words, based on information gathered from such routine experiments, one skilled in the art can readily determine the amino acid positions where further substitutions should be avoided either alone or in combination with other mutations.

A number of scientific publications have been devoted to the prediction of secondary structure. See, Moult, 1996, Curr. Op. in Biotech. 7:422-427; Chou et al., 1974, Biochem. 13:222-245; Chou et al., 1974, Biochemistry 113: 211-222; Chou et al., 1978, Adv. Enzymol. Relat. Areas Mol. Biol. 47:45-148; Chou et al., 1979, Ann. Rev. Biochem. 47:251-276; and Chou et al., 1979, Biophys. J. 26:367-384. Moreover, computer programs are currently available to assist with predicting secondary structure.

In some embodiments, amino acid substitutions are made that: (1) reduce susceptibility to proteolysis, (2) reduce susceptibility to oxidation, (3) alter binding affinity for forming protein complexes, (4) alter ligand or antigen binding affinities, and/or (4) confer or modify other physiochemical or functional properties on such polypeptides. For example, single or multiple amino acid substitutions (in certain embodiments, conservative amino acid substitutions) may be made in the naturally-occurring sequence. Substitutions can be made in that portion of the antibody that lies outside the domain(s) forming intermolecular contacts. In such embodiments, conservative amino acid substitutions can be used that do not substantially change the structural characteristics of the parent sequence (e.g., one or more replacement amino acids that do not disrupt the secondary structure that characterizes the parent or native antigen binding protein). Examples of art-recognized polypeptide secondary and tertiary structures are described in Proteins, Structures and Molecular Principles (Creighton, Ed.), 1984, W. H. New York: Freeman and Company; Introduction to Protein Structure (Branden and Tooze, eds.), 1991, New York: Garland Publishing; and Thornton et al., 1991, Nature 354:105, which are each incorporated herein by reference.

Additional preferred antibody variants include cysteine variants wherein one or more cysteine residues in the parent or native amino acid sequence are deleted from or substituted with another amino acid (e.g., serine). Cysteine variants are useful, inter alia when antibodies must be refolded into a biologically active conformation. Cysteine variants may have fewer cysteine residues than the native antibody, and typically have an even number to minimize interactions resulting from unpaired cysteines.

The heavy and light chains, variable regions domains and CDRs that are disclosed can be used to prepare polypeptides that contain an antigen binding region that can specifically bind to GITR. For example, one or more of the CDRs listed in TABLE 1 can be incorporated into a molecule (e.g., a polypeptide) covalently or noncovalently to make an immunoadhesion. An immunoadhesion may incorporate the CDR(s) as part of a larger polypeptide chain, may covalently link the CDR(s) to another polypeptide chain, or may incorporate the CDR(s) noncovalently. The CDR(s) enable the immunoadhesion to bind specifically to a particular antigen of interest (e.g., a GITR polypeptide or epitope thereof).

L. Mimetics

Mimetics (e.g., "peptide mimetics" or "peptidomimetics") based upon the variable region domains and CDRs that are described herein are also provided. These analogs can be peptides, non-peptides or combinations of peptide and non-peptide regions. Fauchere, 1986, Adv. Drug Res. 15:29; Veber and Freidinger, 1985, TINS p. 392; and Evans et al., 1987, J. Med. Chem. 30:1229, which are incorporated herein by reference for any purpose. Peptide mimetics that are structurally similar to therapeutically useful peptides may be used to produce a similar therapeutic or prophylactic effect. Such compounds are often developed with the aid of computerized molecular modeling. Generally, peptidomimetics are proteins that are structurally similar to an antibody displaying a desired biological activity, such as here the ability to specifically bind GITR, but have one or more peptide linkages optionally replaced by a linkage selected from: —$CH_2NH$—, —$CH_2S$—, —$CH_2$—$CH_2$—, —$CH$═$CH$-(cis and trans), —$COCH_2$—, —$CH(OH)CH_2$—, and —$CH_2SO$—, by methods well known in the art. Systematic substitution of one or more amino acids of a consensus sequence with a D-amino acid of the same type (e.g., D-lysine in place of L-lysine) may be used in certain embodiments to generate more stable proteins. In addition, constrained peptides comprising a consensus sequence or a substantially identical consensus sequence variation may be generated by methods known in the art (Rizo and Gierasch, 1992, Ann. Rev. Biochem. 61:387), incorporated herein by reference), for example, by adding internal cysteine residues capable of forming intramolecular disulfide bridges which cyclize the peptide.

M. Derivatives

Derivatives of the antigen binding proteins that are described herein are also provided. The derivatized antigen binding proteins can comprise any molecule or substance that imparts a desired property to the antibody or fragment, such as increased half-life in a particular use. The derivatized antigen binding protein can comprise, for example, a detectable (or labeling) moiety (e.g., a radioactive, colorimetric, antigenic or enzymatic molecule, a detectable bead (such as a magnetic or electrodense (e.g., gold bead), or a molecule that binds to another molecule (e.g., biotin or streptavidin)), a therapeutic or diagnostic moiety (e.g., a radioactive, cytotoxic, or pharmaceutically active moiety), or a molecule that increases the suitability of the antigen binding protein for a particular use (e.g., administration to a subject, such as a human subject, or other in vivo or in vitro uses). Examples of molecules that can be used to derivatize an antigen binding protein include albumin (e.g., human serum albumin) and polyethylene glycol (PEG). Albumin-linked and PEGylated derivatives of antigen binding proteins can be prepared using techniques well known in the art. Certain antigen binding proteins include a pegylated single chain polypeptide as described herein. In one embodiment, the antigen binding protein is conjugated or otherwise linked to transthyretin (TTR) or a TTR variant. The TTR or TTR variant can be chemically modified with, for example, a chemical selected from the group consisting of dextran, poly(n-vinyl pyrrolidone), polyethylene glycols, propropylene glycol homopolymers, polypropylene oxide/ethylene oxide co-polymers, polyoxyethylated polyols and polyvinyl alcohols.

Other derivatives include covalent or aggregative conjugates of GITR antigen binding proteins with other proteins or polypeptides, such as by expression of recombinant fusion proteins comprising heterologous polypeptides fused to the N-terminus or C-terminus of an GITR antigen binding protein. For example, the conjugated peptide may be a heterologous signal (or leader) polypeptide, e.g., the yeast alpha-factor leader, or a peptide such as an epitope tag. GITR antigen binding protein-containing fusion proteins can comprise peptides added to facilitate purification or identification of the GITR antigen binding protein (e.g., poly-His). An GITR antigen binding protein also can be linked to the FLAG peptide as described in Hopp et al., 1988, Bio/Technology 6:1204; and U.S. Pat. No. 5,011,912. The FLAG peptide is highly antigenic and provides an epitope reversibly bound by a specific monoclonal antibody (mAb), enabling rapid assay and facile purification of expressed recombinant protein. Reagents useful for preparing fusion proteins in which the FLAG peptide is fused to a given polypeptide are commercially available (Sigma, St. Louis, Mo.).

N. Oligomers

Oligomers that contain one or more GITR antigen binding proteins may be employed as GITR agonists. Oligomers may be in the form of covalently-linked or non-covalently-linked dimers, trimers, or higher oligomers. In an embodiment, oligomers comprising two or more GITR antigen binding proteins are provided, with one example being a homodimer. Other oligomers include heterodimers, homotrimers, heterotrimers, homotetramers, heterotetramers and the like.

One embodiment is directed to oligomers comprising multiple GITR-binding polypeptides joined via covalent or non-covalent interactions between peptide moieties fused to the GITR antigen binding proteins. Such peptides may be peptide linkers (spacers), or peptides that have the property of promoting oligomerization. Leucine zippers and certain polypeptides derived from antibodies are among the peptides that can promote oligomerization of GITR antigen binding proteins attached thereto, as described in more detail below.

In particular embodiments, the oligomers comprise from two to four GITR antigen binding proteins. The GITR antigen binding protein moieties of the oligomer may be in any of the forms described above, e.g., variants or fragments. Preferably, the oligomers comprise GITR antigen binding proteins that have agonist activity.

In one embodiment, an oligomer is prepared using polypeptides derived from immunoglobulins. Preparation of fusion proteins comprising certain heterologous polypeptides fused to various portions of antibody-derived polypeptides (including the Fc domain) has been described, e.g., by Ashkenazi et al., 1991, Proc. Natl. Acad. Sci. USA 88:10535; Byrn et al., 1990, Nature 344:677; and Hollenbaugh et al., 1992 "Construction of Immunoglobulin Fusion Proteins", in Current Protocols in Immunology, Suppl. 4, pages 10.19.1-10.19.11.

One embodiment is directed to a dimer comprising two fusion proteins created by fusing an GITR antigen binding protein to the Fc region of an antibody. The dimer can be made by, for example, inserting a gene fusion encoding the fusion protein into an appropriate expression vector, expressing the gene fusion in host cells transformed with the recombinant expression vector, and allowing the expressed fusion protein to assemble much like antibody molecules, whereupon interchain disulfide bonds form between the Fc moieties to yield the dimer.

The term "Fc polypeptide" as used herein includes native and mutein forms of polypeptides derived from the Fc region of an antibody. Truncated forms of such polypeptides containing the hinge region that promotes dimerization also are included. Fusion proteins comprising Fc moieties (and oligomers formed therefrom) offer the advantage of facile purification by affinity chromatography over Protein A or Protein G columns.

One suitable Fc polypeptide, described in PCT application WO 93/10151 and U.S. Pat. No. 5,426,048 and U.S. Pat. No. 5,262,522, is a single chain polypeptide extending from the N-terminal hinge region to the native C-terminus of the Fc region of a human IgG1 antibody. Another useful Fc polypeptide is the Fc mutein described in U.S. Pat. No. 5,457,035, and in Baum et al., 1994, EMBO J. 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

Alternatively, the oligomer is a fusion protein comprising multiple GTR antigen binding proteins, with or without peptide linkers (spacer peptides). Among the suitable peptide linkers are those described in U.S. Pat. No. 4,751,180 and U.S. Pat. No. 4,935,233.

Another method for preparing oligomeric GITR antigen binding protein derivatives involves use of a leucine zipper. Leucine zipper domains are peptides that promote oligomerization of the proteins in which they are found. Leucine zippers were originally identified in several DNA-binding proteins (Landschulz et al., 1988, Science 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191, hereby incorporated by reference. The use of a modified leucine zipper that allows for stable trimerization of a heterologous protein fused thereto is described in Fanslow et al., 1994, Semin. Immunol. 6:267-278. In one approach, recombinant fusion proteins comprising an GITR antigen binding protein fragment or derivative fused to a leucine zipper peptide are expressed in suitable host cells, and the soluble oligomeric GITR antigen binding protein fragments or derivatives that form are recovered from the culture supernatant.

O. Species Cross Reactivity of GITR Antigen Binding Proteins

In one embodiment, the GITR antigen binding protein (e.g., those with sequences as described in TABLE 1) binds a human GITR protein (SEQ ID NO:1) but does not bind mouse GITR (SEQ ID NO:3). In another embodiment, the GITR antigen binding protein binds a human GITR protein (SEQ ID NO:1) and cyno GITR protein (SEQ ID NO:2). In still another embodiment, the GITR antigen binding protein binds human GITR (SEQ ID NO:1) and cyno GITR (SEQ ID NO:2) but does not bind mouse GITR (SEQ ID NO:3).

In various embodiments, the GITR antigen binding protein binds a human GITR protein (e.g., SEQ ID NO:1) with a $K_D$ of ≤1, 2, 5, 10, 20 or 50 nM and binds to a cyno GITR protein (e.g., SEQ ID NO:2) with a $K_D$ of ≤50, 100, 150, 200, 300, 400, 500, 600 or 700 nM. In an aspect, the binding to human and cyno GITR is determined, for example, by BiaCore.

P. Glycosylation State of GITR Antigen Binding Proteins

The antigen-binding protein may have a glycosylation pattern that is different or altered from that found in the native species. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antigen binding protein is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antigen binding protein amino acid sequence may be altered through changes at the DNA level, particularly by mutating the DNA encoding the target polypeptide at preselected bases such that codons are generated that will translate into the desired amino acids.

Another means of increasing the number of carbohydrate moieties on the antigen binding protein is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 published Sep. 11, 1987, and in Aplin and Wriston, 1981, CRC Crit. Rev, Biochem., pp. 259-306.

Removal of carbohydrate moieties present on the starting antigen binding protein may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, *Arch. Biochem. Biophys.* 259:52 and by Edge et al., 1981, *Anal. Biochem.* 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Hence, aspects include glycosylation variants of the antigen binding proteins wherein the number and/or type of glycosylation site(s) has been altered compared to the amino acid sequences of the parent polypeptide. In certain embodiments, antibody protein variants comprise a greater or a lesser number of N-linked glycosylation sites than the native antibody. An N-linked glycosylation site is characterized by the sequence: Asn-X-Ser or Asn-X-Thr, wherein the amino acid residue designated as X may be any amino acid residue except proline. The substitution of amino acid residues to create this sequence provides a potential new site for the addition of an N-linked carbohydrate chain. Alternatively, substitutions that eliminate or alter this sequence will prevent addition of an N-linked carbohydrate chain present in the native polypeptide. For example, the glycosylation can be reduced by the deletion of an Asn or by substituting the Asn with a different amino acid. In other embodiments, one or more new N-linked sites are created. Antibodies typically have a N-linked glycosylation site in the Fc region.

As described in the Examples, it was found that the glycosylation state of certain GITR antigen binding proteins can be an important factor impacting the agonist activity of the protein. In particular, it was found that the antigen binding proteins had improved activity when glycosylated. Accordingly, in some embodiments the antigen binding protein is an antibody in which the constant region is an IgG1, as such immunoglobulins have a glycosylation state that allows for binding to the Fc receptor (FcR). Binding of antibody to Fc receptors on cell surfaces triggers a variety of biological responses including internalization with subsequent destruction of endocytosed antibody-coated particles, clearance of immune complexes, lysis of antibody-coated target cells by killer cells (a process referred to as antibody-dependent cell-mediated cytotoxicity, or simply ADCC for short), control of immunoglobulin production and release of inflammatory mediators. As demonstrated in the Examples, FcR binding by the antigen binding proteins results in greater clustering of the proteins, which in turn was found to result in improved agonist activity. This finding is contrary to certain reports which suggest using GITR antibodies with reduced effector function and/or glycosylation maintain agonistic activity.

Q. Antigen Binding Proteins with Labels and Effector Groups

In some embodiments, the antigen-binding protein comprises one or more labels. The term "labeling group" or "label" means any detectable label. Examples of suitable labeling groups include, but are not limited to, the following: radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used as is seen fit.

The term "effector group" means any group coupled to an antigen binding protein that acts as a cytotoxic agent. Examples for suitable effector groups are radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$). Other suitable groups include toxins, therapeutic groups, or chemotherapeutic groups. Examples of suitable groups include calicheamicin, auristatins, geldanamycin and maytansine. In some embodiments, the effector group is coupled to the antigen binding protein via spacer arms of various lengths to reduce potential steric hindrance.

In general, labels fall into a variety of classes, depending on the assay in which they are to be detected: a) isotopic labels, which may be radioactive or heavy isotopes; b) magnetic labels (e.g., magnetic particles); c) redox active moieties; d) optical dyes; e) enzymatic groups (e.g. horseradish peroxidase, β-galactosidase, luciferase, alkaline phosphatase); f) biotinylated groups; and g) predetermined polypeptide epitopes recognized by a secondary reporter (e.g., leucine zipper pair sequences, binding sites for secondary antibodies, metal binding domains, epitope tags, etc.). In some embodiments, the labeling group is coupled to the antigen binding protein via spacer arms of various lengths to reduce potential steric hindrance. Various methods for labeling proteins are known in the art.

Specific labels include optical dyes, including, but not limited to, chromophores, phosphors and fluorophores, with the latter being specific in many instances. Fluorophores can be either "small molecule" fluores, or proteinaceous fluores.

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland, hereby expressly incorporated by reference.

Suitable proteinaceous fluorescent labels also include, but are not limited to, green fluorescent protein, including a Renilla, Ptilosarcus, or Aequorea species of GFP (Chalfie et al., 1994, Science 263:802-805), EGFP (Clontech Labs., Inc., Genbank Accession Number U55762), blue fluorescent protein (BFP, Quantum Biotechnologies, Inc., Quebec, Canada; Stauber, 1998, Biotechniques 24:462-471; Heim et al., 1996, Curr. Biol. 6:178-182), enhanced yellow fluorescent protein (EYFP, Clontech Labs., Inc.), luciferase (Ichiki et al., 1993, J. Immunol. 150:5408-5417), β galactosidase (Nolan et al., 1988, Proc. Natl. Acad. Sci. U.S.A. 85:2603-2607) and Renilla (WO92/15673, WO95/07463, WO98/14605, WO98/26277, WO99/49019, U.S. Pat. No. 5,292,658, U.S. Pat. No. 5,418,155, U.S. Pat. No. 5,683,888, U.S. Pat. No. 5,741,668, U.S. Pat. No. 5,777,079, U.S. Pat. No. 5,804,387, U.S. Pat. No. 5,874,304, U.S. Pat. No. 5,876,995, U.S. Pat. No. 5,925,558).

IV. Nucleic Acids Encoding GITR Antigen Binding Proteins

Nucleic acids that encode for the antigen binding proteins described herein, or portions thereof, are also provided, including nucleic acids encoding one or both chains of an antibody, or a fragment, derivative, mutein, or variant thereof, polynucleotides encoding heavy chain variable regions or only CDRs, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids). TABLE 3 shows exemplary nucleic acid sequences encoding an IgG1 heavy chain constant region and IgG1 kappa and lambda light chain constant regions. Any variable region provided herein may be attached to these constant regions to form complete heavy and light chain sequences. However, it should be understood that these constant region sequences are provided as specific examples only. In some embodiments, the variable region sequences are joined to other constant region sequences that are known in the art. Exemplary nucleic acid sequences encoding heavy and light chain variable regions are provided in TABLES 3 and 4.

TABLE 3

Exemplary Nucleic Acid Sequences Encoding Heavy and Light Chain Constant Regions

| Chain Type | Nucleic Acid Sequence |
|---|---|
| IgG1 Heavy Chain (SEQ ID NO: 445) | GCTAGCACCAAGGGCCCATCCGTCTTCCCCCTGGC ACCCTCCTCCAAGAGCACCTCTGGGGGCACAGCGG CCCTGGGCTGCCTGGTCAAGGACTACTTCCCCGAA CCGGTGACGGTGTCGTGGAACTCAGGCGCCCTGAC CAGCGGCGTGCACACCTTCCCGGCTGTCCTACAGT CCTCAGGACTCTACTCCCTCAGCAGCGTGGTGACC GTGCCCTCCAGCAGCTTGGGCACCCAGACCTACAT CTGCAACGTGAATCACAAGCCCAGCAACACCAAGG TGGACAAGAGAGTTGAGCCCAAATCTTGTGACAAA ACTCACACATGCCCACCGTGCCCAGCACCTGAACT CCTGGGGGGACCGTCAGTCTTCCTCTTCCCCCCAA AACCCAAGGACACCCTCATGATCTCCCGGACCCCT GAGGTCACATGCGTGGTGGTGGACGTGAGCCACGA AGACCCTGAGGTCAAGTTCAACTGGTACGTGGACG GCGTGGAGGTGCATAATGCCAAGACAAAGCCGCGG GAGGAGCAGTACAACAGCACGTACCGTGTGGTCAG CGTCCTCACCGTCCTGCACCAGGACTGGCTGAATG GCAAGGAGTACAAGTGCAAGGTCTCCAACAAAGCC CTCCCAGCCCCCATCGAGAAAACCATCTCCAAAGC CAAAGGGCAGCCCCGAGAACCACAGGTGTACACCC TGCCCCCATCCCGGGAGGAGATGACCAAGAACCAG GTCAGCCTGACCTGCCTGGTCAAAGGCTTCTATCC CAGCGACATCGCCGTGGAGTGGGAGAGCAATGGGC AGCCGGAGAACAACTACAAGACCACGCCTCCCGTG CTGGACTCCGACGGCTCCTTCTTCCTCTATAGCAA GCTCACCGTGGACAAGAGCAGGTGGCAGCAGGGGA ACGTCTTCTCATGCTCCGTGATGCATGAGGCTCTG CACAACCACTACACGCAGAAGAGCCTCTCCCTGTC TCCGGGTAAATGA |
| IgG1 lambda light chain constant region (SEQ ID NO: 446) | CAACCGAAAGCGGCGCCCTCGGTCACTCTGTTCCC GCCCTCCTCTGAGGAGCTTCAAGCCAACAAGGCCA CACTGGTGTGTCTCATAAGTGACTTCTACCCGGGA GCCGTGACAGTGGCCTGGAAGGCAGATAGCAGCCC CGTCAAGGCGGGAGTGGAGACCACCACACCCTCCA AACAAAGCAACAACAAGTACGCGGCCAGCAGCTAT CTGAGCCTGACGCCTGAGCAGTGGAAGTCCCACAG AAGCTACAGCTGCCAGGTCACGCATGAAGGGAGCA CCGTGGAGAAGACAGTGGCCCCTACAGAATGTTCA TAG |
| IgG1 kappa light chain constant region (SEQ ID NO: 447) | ACGGTGGCTGCACCATCTGTCTTCATCTTCCCGCC ATCTGATGAGCAGTTGAAATCTGGAACTGCCTCTG TTGTGTGCCTGCTGAATAACTTCTATCCCAGAGAG GCCAAAGTACAGTGGAAGGTGGATAACGCCCTCCA ATCGGGTAACTCCCAGGAGAGTGTCACAGAGCAGG ACAGCAAGGACAGCACCTACAGCCTCAGCAGCACC CTGACGCTGAGCAAAGCAGACTACGAGAAACACAA AGTCTACGCCTGCGAAGTCACCCATCAGGGCCTGA GCTCGCCCGTCACAAAGAGCTTCAACAGGGGAGAG TGTTAG |

TABLE 4 provides a summary of exemplary nucleic acid sequences encoding the heavy chain and light chain variable domains of the antigen binding proteins; these sequences also encode the various CDRH1, CDRH2, CDRH3, CDRL1, CDRL2 and CDRL3 sequences included within the variable domains. Thus, in one embodiment, antigen binding proteins encoded by the following nucleic acids are provided.

TABLE 4

Exemplary nucleic acid sequences encoding heavy and light chain variable domains

| Ab No. | Ref. No. | Antibody | VH | VL |
|---|---|---|---|---|
| PARENTAL | | | | |
| Ab1 | SS-10942 | 1D7 | 99 | 80 |
| Ab2 | SS-12413 | 33C9 | 100 | 81 |
| Ab3 | SS-12414 | 33F6 | 101 | 82 |
| Ab4 | SS-12415 | 34G4 | 102 | 83 |
| Ab5 | SS-12416 | 35B10 | 103 | 84 |
| Ab6 | SS-12417 | 41E 11 | 104 | 85 |
| Ab7 | SS-12428 | 41G5 | 105 | 86 |
| Ab8 | SS-12418 | 42A11 | 106 | 87 |
| Ab9 | SS-12419 | 44C1 | 107 | 88 |
| Ab10 | SS-12420 | 45A8 | 108 | 89 |
| Ab11 | SS-12421 | 46E 11 | 109 | 90 |
| Ab12 | SS-12422 | 48H12 | 110 | 91 |
| Ab13 | SS-12423 | 48H7 | 111 | 92 |
| Ab14 | SS-12424 | 49D9 | 112 | 93 |
| Ab15 | SS-12425 | 49E 2 | 113 | 94 |
| Ab16 | SS-12427 | 48A9 | 114 | 95 |
| Ab17 | SS-10943 | 5H7 | 115 | 96 |
| Ab18 | SS-10944 | 7A10 | 116 | 97 |
| Ab19 | SS-10945 | 9H6 | 117 | 98 |
| ENGINEERED | | | | |
| Ab20 | SS-12514 | 44C1v1 | 196 | 156 |
| Ab21 | SS-12515 | 45A8v1 | 197 | 157 |
| Ab22 | SS-12562 | 49D9v1 | 198 | 158 |
| Ab23 | SS-12516 | 49E2v1 | 199 | 159 |
| Ab24 | SS-12513 | 48A9v1 | 200 | 160 |
| Ab25 | SS-16912 | 5H7v1 | 201 | 161 |
| Ab26 | SS-13807 | 5H7v2 | 202 | 162 |
| Ab27 | SS-16913 | 5H7v3 | 203 | 163 |
| Ab28 | SS-16915 | 5H7v5 | 204 | 164 |
| Ab29 | SS-16917 | 5H7v7 | 205 | 165 |
| Ab30 | SS-16921 | 5H7v9 | 206 | 166 |
| Ab31 | SS-16919 | 5H7v10 | 207 | 167 |
| Ab32 | SS-16920 | 5H7v11 | 208 | 168 |
| Ab33 | SS-16923 | 5H7v13 | 209 | 169 |
| Ab34 | SS-16924 | 5H7v14 | 210 | 170 |
| Ab35 | SS-16927 | 5H7v17 | 211 | 171 |
| Ab36 | SS-16928 | 5H7v18 | 212 | 172 |
| Ab37 | SS-16929 | 5H7v19 | 213 | 173 |
| Ab38 | SS-16932 | 5H7v22 | 214 | 174 |
| Ab39 | SS-13810 | 7A10v1 | 215 | 175 |
| Ab40 | SS-16938 | 7A10v2 | 216 | 176 |
| Ab41 | SS-16939 | 7A10v3 | 217 | 177 |
| Ab42 | SS-16940 | 7A10v4 | 218 | 178 |
| Ab43 | SS-16941 | 7A10v5 | 219 | 179 |
| Ab44 | SS-16943 | 9H6v1 | 220 | 180 |
| Ab45 | SS-16944 | 9H6v2 | 221 | 181 |
| Ab46 | SS-13806 | 9H6v3 | 222 | 182 |
| Ab47 | SS-16945 | 9H6v4 | 223 | 183 |
| Ab48 | SS-16946 | 9H6v5 | 224 | 184 |
| Ab49 | SS-16947 | 9H6v6 | 225 | 185 |
| Ab50 | SS-16948 | 33C9v1 | 226 | 186 |
| Ab51 | SS-13808 | 33C9v2 | 227 | 187 |
| Ab52 | SS-16949 | 33C9v3 | 228 | 188 |
| Ab53 | SS-16950 | 33C9v4 | 229 | 189 |
| Ab54 | SS-16951 | 33C9v5 | 230 | 190 |
| Ab55 | SS-16952 | 41G5v1 | 231 | 191 |
| Ab56 | SS-13809 | 41G5v2 | 232 | 192 |
| Ab57 | SS-16953 | 41G5v3 | 233 | 193 |
| Ab58 | SS-16954 | 41G5v4 | 234 | 194 |
| Ab59 | SS-16955 | 41G5v5 | 235 | 195 |

Nucleic acids encoding certain antigen binding proteins, or portions thereof (e.g., full length antibody, heavy or light chain, variable domain, or CDRH1, CDRH2, CDRH3, CDRL1, CDRL2, or CDRL3) may be isolated from B-cells of mice that have been immunized with GITR or an immunogenic fragment thereof. The nucleic acid may be isolated by conventional procedures such as polymerase chain reaction (PCR). Phage display is another example of a known technique whereby derivatives of antibodies and other antigen binding proteins may be prepared. In one approach, polypeptides that are components of an antigen binding protein of interest are expressed in any suitable recombinant expression system, and the expressed polypeptides are allowed to assemble to form antigen binding proteins.

The nucleic acids provided in TABLES 3 and 4 are exemplary only. Due to the degeneracy of the genetic code, each of the polypeptide sequences listed in TABLES 3 and 4 or otherwise depicted herein are also encoded by a large number of other nucleic acid sequences besides those provided.

An aspect further provides nucleic acids that hybridize to other nucleic acids (e.g., nucleic acids comprising a nucleotide sequence listed in TABLE 3 and TABLE 4) under particular hybridization conditions. Methods for hybridizing nucleic acids are well-known in the art. See, e.g., Current Protocols in Molecular Biology, John Wiley & Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65%, 70%, 75%, 80%, 85%, 90%, 95%, 98% or 99% identical to each other typically remain hybridized to each other.

The basic parameters affecting the choice of hybridization conditions and guidance for devising suitable conditions are set forth by, for example, Sambrook, Fritsch, and Maniatis (2001, Molecular Cloning: A Laboratory Manual, Cold Spring Harbor Laboratory Press, Cold Spring Harbor, N.Y., supra; and Current Protocols in Molecular Biology, 1995, Ausubel et al., eds., John Wiley & Sons, Inc., sections 2.10 and 6.3-6.4), and can be readily determined by those having ordinary skill in the art based on, e.g., the length and/or base composition of the nucleic acid.

Changes can be introduced by mutation into a nucleic acid, thereby leading to changes in the amino acid sequence of a polypeptide (e.g., an antibody or antibody derivative) that it encodes. Mutations can be introduced using any technique known in the art. In one embodiment, one or more particular amino acid residues are changed using, for example, a site-directed mutagenesis protocol. In another embodiment, one or more randomly selected residues are changed using, for example, a random mutagenesis protocol. However it is made, a mutant polypeptide can be expressed and screened for a desired property.

Mutations can be introduced into a nucleic acid without significantly altering the biological activity of a polypeptide that it encodes. For example, one can make nucleotide substitutions leading to amino acid substitutions at non-essential amino acid residues. Alternatively, one or more mutations can be introduced into a nucleic acid that selectively changes the biological activity of a polypeptide that it encodes. For example, the mutation can quantitatively or qualitatively change the biological activity. Examples of quantitative changes include increasing, reducing or eliminating the activity. Examples of qualitative changes include changing the antigen specificity of an antibody. In one embodiment, a nucleic acid encoding any antigen binding protein described herein can be mutated to alter the amino acid sequence using molecular biology techniques that are well-established in the art.

Another aspect provides nucleic acid molecules that are suitable for use as primers or hybridization probes for the detection of nucleic acid sequences. A nucleic acid molecule can comprise only a portion of a nucleic acid sequence encoding a full-length polypeptide, for example, a fragment that can be used as a probe or primer or a fragment encoding an active portion (e.g., GITR binding portion) of a polypeptide.

Probes based on the sequence of a nucleic acid can be used to detect the nucleic acid or similar nucleic acids, for example, transcripts encoding a polypeptide. The probe can comprise a label group, e.g., a radioisotope, a fluorescent compound, an enzyme, or an enzyme co-factor. Such probes can be used to identify a cell that expresses the polypeptide.

Another aspect provides vectors comprising a nucleic acid encoding a polypeptide or a portion thereof (e.g., a fragment containing one or more CDRs or one or more variable region domains). Examples of vectors include, but are not limited to, plasmids, viral vectors, non-episomal mammalian vectors and expression vectors, for example, recombinant expression vectors. The recombinant expression vectors can comprise a nucleic acid in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see, Voss et al., 1986, Trends Biochem. Sci. 11:287, Maniatis et al., 1987, Science 236:1237), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems. The design of the expression vector can depend on such factors as the choice of the host cell to be transformed and the level of expression of protein desired. The expression vectors can be introduced into host cells to thereby produce proteins or peptides, including fusion proteins or peptides, encoded by nucleic acids as described herein.

Another aspect provides host cells into which a recombinant expression vector has been introduced. A host cell can be any prokaryotic cell (for example, $E.$ $coli$) or eukaryotic cell (for example, yeast, insect, or mammalian cells (e.g., CHO cells)). Vector DNA can be introduced into prokaryotic or eukaryotic cells via conventional transformation or transfection techniques. For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

V. Preparing GITR Antigen Binding Proteins

Non-human antibodies that are provided can be, for example, derived from any antibody-producing animal, such as mouse, rat, rabbit, goat, donkey, or non-human primate (such as monkey (e.g., cynomolgus or rhesus monkey) or ape (e.g., chimpanzee)). Non-human antibodies can be used, for instance, in in vitro cell culture and cell-culture based applications, or any other application where an immune response to the antibody does not occur or is insignificant, can be prevented, is not a concern, or is desired. In certain embodiments, the antibodies may be produced by immunizing with full-length GITR or a fragment thereof. Alternatively, the certain non-human antibodies may be raised by immunizing with amino acids which are segments of GITR that form part of the epitope to which certain antibodies provided herein bind. The antibodies may be polyclonal, monoclonal, or may be synthesized in host cells by expressing recombinant DNA.

Fully human antibodies may be prepared as described above by immunizing transgenic animals containing human immunoglobulin loci or by selecting a phage display library that is expressing a repertoire of human antibodies.

The monoclonal antibodies (mAbs) can be produced by a variety of techniques, including conventional monoclonal antibody methodology, e.g., the standard somatic cell hybridization technique of Kohler and Milstein, 1975, *Nature* 256:495. Alternatively, other techniques for producing monoclonal antibodies can be employed, for example, the viral or oncogenic transformation of B-lymphocytes. One suitable animal system for preparing hybridomas is the murine system, which is a very well established procedure. Immunization protocols and techniques for isolation of immunized splenocytes for fusion are known in the art. For such procedures, B cells from immunized mice are fused with a suitable immortalized fusion partner, such as a murine myeloma cell line. If desired, rats or other mammals besides can be immunized instead of mice and B cells from such animals can be fused with the murine myeloma cell line to form hybridomas. Alternatively, a myeloma cell line from a source other than mouse may be used. Fusion procedures for making hybridomas also are well known.

The single chain antibodies that are provided may be formed by linking heavy and light chain variable domain (Fv region) fragments via an amino acid bridge (short peptide linker), resulting in a single polypeptide chain. Such single-chain Fvs (scFvs) may be prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., 1997, Prot. Eng. 10:423; Kortt et al., 2001, Biomol. Eng. 18:95-108). By combining different $V_L$ and $V_H$-comprising polypeptides, one can form multimeric scFvs that bind to different epitopes (Kriangkum et al., 2001, Biomol. Eng. 18:31-40). Techniques developed for the production of single chain antibodies include those described in U.S. Pat. No. 4,946,778; Bird, 1988, Science 242:423; Huston et al., 1988, Proc. Natl. Acad. Sci. U.S.A. 85:5879; Ward et al., 1989, Nature 334:544, de Graaf et al., 2002, Methods Mol Biol. 178:379-387. Single chain antibodies derived from antibodies provided herein include, but are not limited to scFvs comprising the variable domain combinations of the heavy and light chain variable regions depicted in TABLE 1, or combinations of light and heavy chain variable domains which include CDRs depicted in TABLE 1.

Antibodies provided herein that are of one subclass can be changed to antibodies from a different subclass using subclass switching methods. Thus, IgG antibodies may be derived from an IgM antibody, for example, and vice versa. Such techniques allow the preparation of new antibodies that possess the antigen binding properties of a given antibody (the parent antibody), but also exhibit biological properties associated with an antibody isotype or subclass different from that of the parent antibody. Recombinant DNA techniques may be employed. Cloned DNA encoding particular antibody polypeptides may be employed in such procedures, e.g., DNA encoding the constant domain of an antibody of the desired isotype. See, e.g., Lantto et al., 2002, Methods Mol. Biol. 178:303-316.

Accordingly, the antibodies that are provided include those comprising, for example, the variable domain combinations described, supra., having a desired isotype (for example, IgA, IgG1, IgG2, IgG3, IgG4, IgE, and IgD) as well as Fab or F(ab')$_2$ fragments thereof. Moreover, if an IgG4 is desired, it may also be desired to introduce a point mutation (CPSCP (SEQ ID NO:448)->CPPCP (SEQ ID NO:449)) in the hinge region as described in Bloom et al., 1997, Protein Science 6:407, incorporated by reference herein) to alleviate a tendency to form intra-H chain disulfide bonds that can lead to heterogeneity in the IgG4 antibodies.

Moreover, techniques for deriving antibodies having different properties (i.e., varying affinities for the antigen to which they bind) are also known. One such technique, referred to as chain shuffling, involves displaying immunoglobulin variable domain gene repertoires on the surface of filamentous bacteriophage, often referred to as phage display. Chain shuffling has been used to prepare high affinity antibodies to the hapten 2-phenyloxazol-5-one, as described by Marks et al., 1992, BioTechnology 10:779.

Conservative modifications may be made to the heavy and light chain variable regions described in TABLE 1, or the CDRs described in TABLE 1 (and corresponding modifications to the encoding nucleic acids) to produce a GITR antigen binding protein having functional and biochemical characteristics. Methods for achieving such modifications are described above.

GITR antigen binding proteins may be further modified in various ways. For example, if they are to be used for therapeutic purposes, they may be conjugated with polyethylene glycol (pegylated) to prolong the serum half-life or to enhance protein delivery. Alternatively, the V region of the subject antibodies or fragments thereof may be fused with the Fc region of a different antibody molecule. The Fc region used for this purpose may be modified so that it does not bind complement, thus reducing the likelihood of inducing cell lysis in the patient when the fusion protein is used as a therapeutic agent. In addition, the subject antibodies or functional fragments thereof may be conjugated with human serum albumin to enhance the serum half-life of the antibody or fragment thereof. Another useful fusion partner for the antigen binding proteins or fragments thereof is transthyretin (TTR). TTR has the capacity to form a tetramer, thus an antibody-TTR fusion protein can form a multivalent antibody which may increase its binding avidity.

Alternatively, substantial modifications in the functional and/or biochemical characteristics of the antigen binding proteins described herein may be achieved by creating substitutions in the amino acid sequence of the heavy and light chains that differ significantly in their effect on maintaining (a) the structure of the molecular backbone in the area of the substitution, for example, as a sheet or helical conformation, (b) the charge or hydrophobicity of the molecule at the target site, or (c) the bulkiness of the side chain. A "conservative amino acid substitution" may involve a substitution of a native amino acid residue with a nonnative residue that has little or no effect on the polarity or charge of the amino acid residue at that position. See, TABLE 2, supra. Furthermore, any native residue in the polypeptide may also be substituted with alanine, as has been previously described for alanine scanning mutagenesis.

Amino acid substitutions (whether conservative or non-conservative) of the subject antibodies can be implemented by those skilled in the art by applying routine techniques. Amino acid substitutions can be used to identify important residues of the antibodies provided herein, or to increase or decrease the affinity of these antibodies for GITR.

VI. Methods of Expressing Antigen Binding Proteins

Expression systems and constructs in the form of plasmids, expression vectors, transcription or expression cassettes that comprise at least one polynucleotide as described above are also provided herein, as well host cells comprising such expression systems or constructs.

The antigen binding proteins provided herein may be prepared by any of a number of conventional techniques. For example, GITR antigen binding proteins may be produced by recombinant expression systems, using any technique known in the art. See, e.g., Monoclonal Antibodies, Hybridomas: A New Dimension in Biological Analyses, Kennet et al. (eds.) Plenum Press, New York (1980); and Antibodies: A Laboratory Manual, Harlow and Lane (eds.), Cold Spring Harbor Laboratory Press, Cold Spring Harbor, N.Y. (1988).

Antigen binding proteins can be expressed in hybridoma cell lines (e.g., in particular antibodies may be expressed in hybridomas) or in cell lines other than hybridomas. Expression constructs encoding the antibodies can be used to transform a mammalian, insect or microbial host cell. Transformation can be performed using any known method for introducing polynucleotides into a host cell, including, for example packaging the polynucleotide in a virus or bacteriophage and transducing a host cell with the construct by transduction procedures known in the art, as exemplified by U.S. Pat. No. 4,399,216; U.S. Pat. No. 4,912,040; U.S. Pat. No. 4,740,461; U.S. Pat. No. 4,959,455. The optimal transformation procedure used will depend upon which type of host cell is being transformed. Methods for introduction of heterologous polynucleotides into mammalian cells are well known in the art and include, but are not limited to, dextran-mediated transfection, calcium phosphate precipitation, polybrene mediated transfection, protoplast fusion, electroporation, encapsulation of the polynucleotide(s) in liposomes, mixing nucleic acid with positively-charged lipids, and direct microinjection of the DNA into nuclei.

Recombinant expression constructs typically comprise a nucleic acid molecule encoding a polypeptide comprising one or more of the following: one or more CDRs provided herein; a light chain constant region; a light chain variable region; a heavy chain constant region (e.g., $C_H1$, $C_H2$ and/or $C_H3$); and/or another scaffold portion of an GITR antigen binding protein. These nucleic acid sequences are inserted into an appropriate expression vector using standard ligation techniques. In one embodiment, the heavy or light chain constant region is appended to the C-terminus of the anti-GITR specific heavy or light chain variable region and is ligated into an expression vector. The vector is typically selected to be functional in the particular host cell employed (i.e., the vector is compatible with the host cell machinery, permitting amplification and/or expression of the gene can occur). In some embodiments, vectors are used that employ protein-fragment complementation assays using protein reporters, such as dihydrofolate reductase (see, for example, U.S. Pat. No. 6,270,964, which is hereby incorporated by reference). Suitable expression vectors can be purchased, for example, from Invitrogen Life Technologies or BD Biosciences (formerly "Clontech"). Other useful vectors for cloning and expressing the antibodies and fragments include those described in Bianchi and McGrew, 2003, Biotech. Biotechnol. Bioeng. 84:439-44, which is hereby incorporated by reference. Additional suitable expression vectors are discussed, for example, in Methods Enzymol., vol. 185 (D. V. Goeddel, ed.), 1990, New York: Academic Press.

Typically, expression vectors used in any of the host cells will contain sequences for plasmid maintenance and for cloning and expression of exogenous nucleotide sequences. Such sequences, collectively referred to as "flanking sequences" in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the GITR antigen binding protein coding sequence; the oligonucleotide sequence encodes polyHis (such as hexaHis (SEQ ID NO:450)), or another "tag" such as FLAG®, HA (hemaglutinin influenza virus), or myc, for which commercially available antibodies exist. This tag is typically fused to the polypeptide upon expression of the polypeptide, and can serve as a means for affinity purification or detection of the GITR antigen binding protein from the host cell. Affinity purification can be accomplished, for example, by column chromatography using antibodies against the tag as an affinity matrix. Optionally, the tag can subsequently be removed from the purified GITR antigen binding protein by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using the methods described herein for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, Calif.), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, Mass.) is suitable for most gram-negative bacteria, and various viral origins (e.g., SV40, polyoma, adenovirus, vesicular stomatitis virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located at the 3' end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using methods for nucleic acid synthesis such as those described herein.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thyrnidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as an antigen binding protein that binds GITR polypeptide. As a result, increased quantities of a polypeptide such as an antigen binding protein are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed.

In some cases, such as where glycosylation is desired in a eukaryotic host cell expression system, one may manipulate the various pre- or pro-sequences to improve glycosylation or yield. For example, one may alter the peptidase cleavage site of a particular signal peptide, or add prosequences, which also may affect glycosylation. The final protein product may have, in the −1 position (relative to the first amino acid of the mature protein), one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning vectors will typically contain a promoter that is recognized by the host organism and operably linked to the molecule encoding the GITR antigen binding protein. Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the DNA encoding heavy chain or light chain comprising a GITR antigen binding protein by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus, and Simian Virus 40 (SV40). Other suitable mammalian promoters include heterologous mammalian promoters, for example, heat-shock promoters and the actin promoter.

An enhancer sequence may be inserted into the vector to increase transcription of DNA encoding light chain or heavy chain comprising an GITR antigen binding protein by higher eukaryotes. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides that are functional in mammalian host cells include the following: the signal sequence for interleukin-7 (IL-7) described in U.S. Pat. No. 4,965,195; the signal sequence for interleukin-2 receptor described in Cosman et al., 1984, Nature 312:768; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

The expression vectors that are provided may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art.

After the vector has been constructed and a nucleic acid molecule encoding light chain, a heavy chain, or a light chain and a heavy chain comprising an GITR antigen binding sequence has been inserted into the proper site of the vector, the completed vector may be inserted into a suitable host cell for amplification and/or polypeptide expression. The transformation of an expression vector for an antigen-binding protein into a selected host cell may be accomplished by well known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes an antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Mammalian cell lines available as hosts for expression are well known in the art and include, but are not limited to, immortalized cell lines available from the American Type Culture Collection (ATCC), including but not limited to Chinese hamster ovary (CHO) cells, HeLa cells, baby hamster kidney (BHK) cells, monkey kidney cells (COS), human hepatocellular carcinoma cells (e.g., Hep G2), and a number of other cell lines. In certain embodiments, cell lines may be selected through determining which cell lines have high expression levels and constitutively produce antigen binding proteins with GITR binding properties. In another embodiment, a cell line from the B cell lineage that does not make its own antibody but has a capacity to make and secrete a heterologous antibody can be selected.

VII. Use of GITR Antigen Binding Proteins in Therapy

The key role that GITR plays in an immune response makes it an attractive target for immunotherapy, including inducing or enhancing an immune response against desired tumor antigens or pathogenic antigens (e.g., viruses and other pathogenic organisms). As such, the antigen binding proteins have utility in the treatment of various cancers and infectious disease.

As noted above, GITR activation sends a co-activating signal to CD4+ and CD8+ T cells and prevents suppression of an immune response by regulatory T cells. Thus, in one embodiment, a GITR antigen binding protein is administered to inhibit the suppression of effector T cell activity by regulatory T cells. Such inhibition can be assayed by a variety of methods known in the art, including, for example, by monitoring T cell proliferation, expression of known markers of activation, or cytokine secretion. In another embodiment, a GITR antigen binding protein is administered to a subject to decrease the level of regulatory T cells, for instance the level of circulating regulatory T cells. In yet another embodiment, the activity of effector T cells is induced or enhanced by administering an antigen binding protein as provided herein. Specific assays for each of these methods are provided in the Examples.

A. Treatment of Cancer

A couple aspects of GITR biology make it a potential target for the treatment of a variety of cancers. The first is that GITR activation, as described at length above, activates the immune system. Additionally, GITR-expressing effector T cells and regulatory T cells infiltrate multiple tumor types, yet there is little or no expression of GITR on non-hematopoetic cells. This distribution profile means that GITR-expressing cells can become concentrated at tumors. This combination of activities and distribution collectively makes GITR activation an attractive approach for treating a variety of cancers. The antigen binding proteins can be used to treat both solid tumors, as well as hematological cancers, including leukemia.

A variety of different tumors have been demonstrated to contain GITR positive immune cells. Accordingly, these tumors are particularly attractive targets. Such tumors include, for instance, melanoma (including Stage III and Stage IV malignant melanoma), lung cancer (e.g., non-small cell lung cancer—NSCLC), head and neck cancer, renal cell carcinoma and colorectal cancer.

Other cancers that can be treated with the antigen binding proteins include, but are not limited to, breast, prostate, endometrial, bladder, kidney, esophageal, testicular, ovarian, bladder, squamous cell carcinoma (e.g., squamous cell carcinoma of the head and neck—SCCHN), uveal melanoma, follicular lymphoma, cervical, brain, pancreatic, liver, lymphoma, Hodgkin's disease, multiple myeloma, gastric cancer, and astrocyctic cancer.

In treating any of the foregoing cancers, the treatment methods that are provided can be utilized to inhibit further tumor growth, induce tumor regression, increase progression-free survival and/or extend overall survival in an individual that has a tumor. In some embodiments, the antigen binding protein can also delay or prevent the onset of metastasis. Progress in treatment can be monitored using various methods. For instance, inhibition can result in reduced tumor size and/or a decrease in metabolic activity within the tumor. Both of these parameters can be measured by MRI or PET scans for example. Inhibition can also be monitored by biopsy to ascertain the level of necrosis, tumor cell death and the level of vascularity within the tumor. The extent of metastasis can be monitored using known methods.

Although the GITR antigen binding proteins that are provided can be administered alone, in other embodiments the antigen binding protein is administered in combination with another therapeutic agent (e.g., a chemotherapeutic agent), radiation therapy and/or surgery. If administered with another therapeutic agent, the antigen binding protein can be administered before, after, or concurrently with the agent (e.g., as part of the same composition). Other therapeutic agents that can be combined with the antigen binding protein include, for example, other immunotherapy agents, various targeted therapies (e.g., therapeutic antibodies used in cancer treatment), angiogenesis inhibitors, chemotherapy agents, and agents that inhibit bone loss associated with cancer metastasis.

For example, in one embodiment, the antigen binding protein is administered in combination with another immunotherapy agent, i.e., an immunostimulatory agent that induces or enhances an immune response. Such agents can include, for example: 1) activators of dendritic cells, 2) vaccine adjuvants, 3) T cell stimulators, 4) inhibitors of immune checkpoints, and 5) inhibitors of suppressive cells, cytokines and/or enzymes.

Thus, in one embodiment, an antigen binding protein is administered with a dendritic cell growth factor, such as Flt3L.

In another embodiment, an antigen binding protein is combined with an agent that stimulates antigen-presenting cells. Examples of such agents include various CD40 agonists, such as an agonist anti-CD40 antibody or CD40L.

Some methods involve administering an antigen binding protein with a vaccine adjuvant. Such adjuvants include, for instance, IL-12, and various Toll Like Receptor (TLR) agonists, including CpG (a TLR 9 agonist), monophosphoryl lipid A (MPL—a TLR4 agonist), PolyI:C or PolyICLC (TLR3 agonist), and resiquimod and 852A (TLR 7/8 agonists).

In other therapeutic approaches, an antigen binding protein is administered in combination with T cell growth factors such as IL-15 and/or IL-17, or activators of these molecules. In related methods, a T cell stimulator is combined with an antigen binding protein. Such stimulators include agonists of 4-1BB, such as agonist anti-4-1BB antibodies and 4-1BBL.

In certain embodiments, an antigen binding protein is administered with a T cell checkpoint inhibitor, e.g., molecules that send an inhibitory signal to the immune system. Examples of such agents include inhibitors of PD-1 or PD-L1 (B7-H1), such as anti-PD-1 antibodies, including nivolumab (Bristol-Myers Squibb) and lambrolizumab, also known as MK-3475 (Merck), pidilizumab (Curetech), AMP-224 (Amplimmune), and anti-PD-L1 antibodies, including MPDL3280A (Roche), MDX-1105 (Bristol Myer Squibb), MEDI-4736 (AstraZeneca) and MSB-0010718C (Merck). Other checkpoint inhibitors include antagonists of CTLA-4, such as anti-CTLA-4 antibodies. An exemplary anti-CTLA4 antibody is Yervoy® (ipilimumab) marketed by Bristol-Myers Squibb. Other exemplary CTLA-4 antibodies include tremelimumab (Pfizer), Ticilimumab (AstraZeneca) and AMGP-224 (Glaxo Smith Kline).

In yet other methods, an antigen binding protein is administered in combination with an inhibitor of an enzyme that has an immunosuppressive effect. An example is 1-methyl tryptophan (1MT), which is a small molecule inhibitor of indoleamine 2,3-dioxygenase.

The antigen binding proteins can also be used in combination with T-VEC (talimogene laherparepvec) by Amgen.

In certain embodiments, the antigen binding protein is administered in combination with a BiTE® molecule, which is a class of bispecific antibodies that can be used as anti-cancer drugs. The molecules direct the immune system of a host, in particular the cyotoxic activity of T-cells, against cancer cells. Examples include AMG-103 (blinatumumab) and AMG-110 (solitomab) in development by Amgen.

An antigen binding protein can also be administered in combination with a variety of targeted therapies. Examples of targeted therapies include, but are not limited to, use of therapeutic antibodies. Exemplary antibodies include, but are not limited to, those which bind to cell surface proteins Her2, CDC20, CDC33, mucin-like glycoprotein, and epidermal growth factor receptor (EGFR) present on tumor cells, and optionally induce a cytostatic and/or cytotoxic effect on tumor cells displaying these proteins. Exemplary antibodies also include HERCEPTIN® (trastuzumab), which may be used to treat breast cancer and other forms of cancer, and RITUXAN® (rituximab), ZEVALIN™ (ibritumomab tiuxetan), GLEEVEC® and LYMPHOCIDE™ (epratuzumab), which may be used to treat non-Hodgkin's lymphoma and other forms of cancer. Certain exemplary antibodies also include panitumumab (VECTIBIX®), ERBITUX® (IMC-C225); ertinolib (Iressa); BEXXAR™ (iodine 131 tositumomab); KDR (kinase domain receptor) inhibitors; anti VEGF antibodies and antagonists (e.g., Avastin®, motesanib, and VEGAF-TRAP); anti VEGF receptor antibodies and antigen binding regions; anti-Ang-1 and Ang-2 antibodies and antigen binding regions; antibodies to Tie-2 and other Ang-1 and Ang-2 receptors; Tie-2 ligands; antibodies against Tie-2 kinase inhibitors; inhibitors of Hif-1a, and Campath™ (Alemtuzumab). In certain embodiments, cancer therapy agents are polypeptides which selectively induce apoptosis in tumor cells, including, but not limited to, the TNF-related polypeptide TRAIL.

In certain embodiments, an antigen binding protein as provided herein is used in combination with one or more anti-angiogenic agents that decrease angiogenesis. Certain such agents include, but are not limited to, IL-8 antagonists; Campath, B-FGF; FGF antagonists; Tek antagonists (Cerretti et al., U.S. Publication No. 2003/0162712; Cerretti et al., U.S. Pat. No. 6,413,932, and Cerretti et al., U.S. Pat. No. 6,521,424); anti-TWEAK agents (which include, but are not limited to, antibodies and antigen binding regions); soluble TWEAK receptor antagonists (Wiley, U.S. Pat. No. 6,727,225); an ADAM distintegrin domain to antagonize the binding of integrin to its ligands (Fanslow et al., U.S. Publication No. 2002/0042368); anti-eph receptor and anti-ephrin antibodies; antigen binding regions, or antagonists (U.S. Pat. Nos. 5,981,245; 5,728,813; 5,969,110; 6,596,852; 6,232,447; 6,057,124); anti-VEGF agents (e.g., antibodies or antigen binding regions that specifically bind VEGF, or soluble VEGF receptors or a ligand binding regions thereof) such as Avastin® or VEGF-TRAP™, and anti-VEGF receptor agents (e.g., antibodies or antigen binding regions that specifically bind thereto), EGFR inhibitory agents (e.g., antibodies or antigen binding regions that specifically bind thereto) such as panitumumab, IRESSA™ (gefitinib), TARCEVA™ (erlotinib), anti-Ang-1 and anti-Ang-2 agents (e.g., antibodies or antigen binding regions specifically binding thereto or to their receptors, e.g., Tie-2/TEK), and anti-Tie-2 kinase inhibitory agents (e.g., antibodies or antigen binding regions that specifically bind and inhibit the activity of growth factors, such as antagonists of hepatocyte growth factor (HGF, also known as Scatter Factor), and antibodies or antigen binding regions that specifically bind its receptor "c-met" (e.g., rilotumumab and AMG 337, Amgen); anti-PDGF-BB antagonists; antibodies and antigen binding regions to PDGF-BB ligands; and PDGFR kinase inhibitors.

Other anti-angiogenic agents that can be used in combination with an antigen binding protein include agents such as MMP-2 (matrix-metalloproteinase 2) inhibitors, MMP-9 (matrix-metalloproteinase 9) inhibitors, and COX-II (cyclooxygenase II) inhibitors. Examples of useful COX-II inhibitors include CELEBREX™ (celecoxib), valdecoxib, and rofecoxib.

An antigen binding protein as provided herein can also be used in combination with a growth factor inhibitor. Examples of such agents, include, but are not limited to, agents that can inhibit EGF-R (epidermal growth factor receptor) responses, such as EGF-R antibodies (e.g., panitumumab (VECTIBIX®)), EGF antibodies, and molecules that are EGF-R inhibitors; VEGF (vascular endothelial growth factor) inhibitors, such as VEGF receptors and molecules that can inhibit VEGF; and erbB2 receptor inhibitors, such as organic molecules or antibodies that bind to the erbB2 receptor, for example, HERCEPTIN® (Genentech, Inc.). EGF-R inhibitors are described in, for example in U.S. Pat. No. 5,747,498, WO 98/14451, WO 95/19970, and WO 98/02434.

In some treatment applications, particularly when the cancer has metastasized to the bone such that the bone is negatively impacted, it can be useful to administer the antigen binding protein with a therapeutic agent that inhibits further bone loss or aids in restoring bone that has been lost. Accordingly, the antigen binding protein can be administered with a therapeutically effective amount of a bone growth promoting (anabolic) agent or a bone anti-resorptive agent including but not limited to: bone morphogenic factors designated BMP-1 to BMP-12; transforming growth factor-β and TGF-β family members; fibroblast growth factors FGF-1 to FGF-10; interleukin-1 inhibitors (including IL-1ra, antibodies to IL-1 and antibodies to IL-1 receptors); TNFα inhibitors (including etanercept, adalibumab and infliximab); RANK ligand inhibitors (including soluble RANK, osteoprotegerin and antagonistic antibodies that specifically bind RANK or RANK ligand, such as denosumab (XGEVA®)), Dkk-1 inhibitors (e.g., anti-Dkk-1 antibodies), parathyroid hormone, E series prostaglandins, bisphosphonates and bone-enhancing minerals such as fluoride and calcium. Anabolic agents that can be used in combination with the antigen binding proteins and functional fragments thereof include parathyroid hormone and insulin-like growth factor (IGF), wherein the latter agent is preferably complexed with an IGF binding protein. An IL-1 receptor antagonist suitable for such combination treatment is described in WO89/11540 and a suitable soluble TNF receptor-1 is described in WO98/01555. Exemplary RANK ligand antagonists are disclosed, for example, in WO 03/086289, WO 03/002713, U.S. Pat. Nos. 6,740,511 and 6,479,635.

In certain embodiments, a treatment method involves combining an antigen binding protein such as provided herein in combination with one or more chemotherapeutic agents. Examples of such treatments include, but are not limited to, anti-neoplastic agents including alkylating agents including: nitrogen mustards, such as mechlorethamine, cyclophosphamide, ifosfamide, melphalan and chlorambucil; nitrosoureas, such as carmustine (BCNU), lomustine (CCNU), and semustine (methyl-CCNU); Temodal™ (temozolamide), ethylenimines/methylmelamine such as thriethylenemelamine (TEM), triethylene, thiophosphoramide (thiotepa), hexamethylmelamine (HMM, altretamine); alkyl sulfonates such as busulfan; triazines such as dacarbazine (DTIC); antimetabolites including folic acid analogs such as methotrexate and trimetrexate, pyrimidine analogs such as 5-fluorouracil (5FU), fluorodeoxyuridine, gemcitabine, cytosine arabinoside (AraC, cytarabine), 5-azacytidine, 2,2'-difluorodeoxycytidine, purine analogs such as 6-mercaptopurine, 6-thioguanine, azathioprine, 2'-deoxycoformycin (pentostatin), erythrohydroxynonyladenine (EHNA), fludarabine phosphate, and 2-chlorodeoxyadenosine (cladribine, 2-CdA); natural products including antimitotic drugs such as paclitaxel, vinca alkaloids including vinblastine (VLB), vincristine, and vinorelbine, taxotere, estramustine, and estramustine phosphate; pipodophylotoxins such as etoposide and teniposide; antibiotics such as actimomycin D, daunomycin (rubidomycin), doxorubicin, mitoxantrone, idarubicin, bleomycins, plicamycin (mithramycin), mitomycinC, and actinomycin; enzymes such as L-asparaginase; biological response modifiers such as interferon-alpha, IL-2, G-CSF and GM-CSF; miscellaneous agents including platinum coordination complexes such as cisplatin and carboplatin, anthracenediones such as mitoxantrone, substituted urea such as hydroxyurea, methylhydrazine derivatives including N-methylhydrazine (MIH) and procarbazine, adrenocortical suppressants such as mitotane (o,p-DDD) and aminoglutethimide; hormones and antagonists including adrenocorticosteroid antagonists such as prednisone and equivalents, dexamethasone and aminoglutethimide; Gemzar™ (gemcitabine), progestin such as hydroxyprogesterone caproate, medroxyprogesterone acetate and megestrol acetate; estrogen such as diethylstilbestrol and ethinyl estradiol equivalents; antiestrogen such as tamoxifen; androgens including testosterone propionate and fluoxymesterone/equivalents; antiandrogens such as flutamide, gonadotropin-releasing hormone analogs and leuprolide; and non-steroidal antiandrogens such as flutamide. Therapies targeting epigenetic mechanism including, but not limited to, histone deacetylase inhibitors, demethylating agents (e.g., Vidaza) and release of transcriptional repression (ATRA) therapies can also be combined with the antigen binding proteins.

Additional specific examples of chemotherapeutic agents include, taxol, taxenes (e.g., docetaxel and Taxotere), modified paclitaxel (e.g., Abraxane and Opaxio) doxorubicin, Avastin®, Sutent, Nexavar, and other multikinase inhibitors, cisplatin and carboplatin, etoposide, gemcitabine, and vinblastine. Specific inhibitors of other kinases can also be used in combination with the antigen binding proteins, including but not limited to, MAPK pathway inhibitors (e.g., inhibitors of ERK, JNK and p38), PI3kinase/AKT inhibitors and Pim inhibitors. Other inhibitors include Hsp90 inhibitors, proteasome inhibitors (e.g., Velcade) and multiple mechanism of action inhibitors such as Trisenox.

In some embodiments, a GITR antigen binding protein is conjugated to a drug to form an antibody drug conjugate (ADC). Generally, an ADC comprises an antibody conjugated to a chemotherapeutic agent, e.g., a cytotoxic agent, a cytostatic agent, a toxin, or a radioactive agent, such as, for instance, those described above. A linker molecule can be used to conjugate the drug to the antibody. A wide variety of linkers and drugs useful in ADC technology are known in the art and may be used in the formation of ADCs that contain a GITR antigen binding protein. (See, e.g., US20090028856; US2009/0274713; US2007/0031402; WO2005/084390; WO2009/099728; U.S. Pat. No. 5,208,020; U.S. Pat. No. 5,416,064; U.S. Pat. Nos. 5,475,092; 5,585,499; 6,436,931; 6,372,738; and 6,340,701, each of which are incorporated herein by reference).

B. Treatment of Infection

In addition to use in treating cancer, in another embodiment, the antigen binding proteins that are provided can be used to induce or enhance an immune response against foreign antigens, such as those present on various infectious agents. Examples of antigens present on infectious agents against which an immune response can be generated include, but are not limited to proteins, glycoproteins, lipoproteins and glycolipids present on viruses, parasites, bacteria, and other microorganisms.

In certain embodiments, the GITR antigen binding proteins that are provided are incorporated into a vaccine against an infectious agent as part of a prophylactic treatment. In such treatments, an individual is immunized with a vaccine containing the antigen to which immunity is desired and an antigen binding protein as disclosed herein. Alternatively, an expression vector encoding the gene for the pathogenic antigen and the antigen binding protein can be utilized for the vaccination.

C. Detection and Diagnostic Methods

The antigen binding proteins that are described herein can be used to detect GITR (e.g., in a biological sample, such as serum or plasma) and for diagnostic purposes to detect, diagnose, or monitor diseases and/or conditions associated with GITR or GITR treatment. For example, the disclosed antigen binding proteins provide for the detection of the presence of GITR in a sample using classical immunohistological methods known to those of skill in the art (e.g., Tijssen, 1993, Practice and Theory of Enzyme Immunoassays, Vol 15 (Eds R. H. Burdon and P. H. van Knippenberg, Elsevier, Amsterdam); Zola, 1987, Monoclonal Antibodies: A Manual of Techniques, pp. 147-158 (CRC Press, Inc.); Jalkanen et al., 1985, J. Cell. Biol. 101:976-985; Jalkanen et al., 1987, J. Cell Biol. 105:3087-3096). The detection of GITR can be performed in vivo or in vitro.

Diagnostic applications provided herein include use of the antigen binding proteins to detect expression of GITR and binding of the ligands to GITR. Examples of methods useful in the detection of the presence of GITR include immunoassays, such as the enzyme linked immunosorbent assay (ELISA) and the radioimmunoassay (RIA).

For diagnostic applications, the antigen binding protein typically will be labeled with a detectable labeling group. Suitable labeling groups include, but are not limited to, the following: radioisotopes or radionuclides (e.g., $^{3}$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used.

In another aspect, an antigen binding protein can be used to identify a cell or cells that express GITR. In a specific embodiment, the antigen binding protein is labeled with a labeling group and the binding of the labeled antigen binding protein to GITR is detected. In a further specific embodiment, the binding of the antigen binding protein to GITR is detected in vivo. In a further specific embodiment, the GITR antigen binding protein is isolated and measured using techniques known in the art. See, for example, Harlow and Lane, 1988, Antibodies: A Laboratory Manual, New York: Cold Spring Harbor (ed. 1991 and periodic supplements); John E. Coligan, ed., 1993, Current Protocols In Immunology New York: John Wiley & Sons.

In another embodiment, methods are provided for detecting the presence of a test molecule that competes for binding to GITR with the antigen binding proteins that are provided herein. An example of one such assay would involve detecting the amount of free antigen binding protein in a solution containing an amount of GITR in the presence or absence of the test molecule. An increase in the amount of free antigen binding protein (i.e., the antigen binding protein not bound to GITR) would indicate that the test molecule is capable of competing for GITR binding with the antigen binding protein. In one embodiment, the antigen binding protein is labeled with a labeling group. Alternatively, the test molecule is labeled and the amount of free test molecule is monitored in the presence and absence of an antigen binding protein. A variety of additional methods for determining competition are known in the art; methods are also provided in the Examples below.

VIII. Pharmaceutical Formulations and Administration

Pharmaceutical compositions that comprise a GITR antigen binding protein are also provided and can be utilized in any of the preventive and therapeutic methods disclosed herein. In an embodiment, a therapeutically effective amount of one or a plurality of the antigen binding proteins and a pharmaceutically acceptable diluent, carrier, solubilizer, emulsifier, preservative, and/or adjuvant are also provided. Acceptable formulation materials are nontoxic to recipients at the dosages and concentrations employed. Pharmaceutical compositions can be formulated as liquid, frozen or lyophilized compositions.

In certain embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides, disaccharides, and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. REMINGTON'S PHARMACEUTICAL SCIENCES, 18" Edition, (A. R. Genrmo, ed.), 1990, Mack Publishing Company provides additional details and options for suitable agents that can be incorporated into the pharmaceutical compositions.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antigen binding proteins disclosed. In certain embodiments, the primary vehicle or carrier in a pharmaceutical composition may be either aqueous or non-aqueous in nature. For example, a suitable vehicle or carrier may be water for injection or physiological saline solution. In certain embodiments, GITR antigen binding protein compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the GITR antigen binding protein may be formulated as a lyophilizate using appropriate excipients such as sucrose.

As discussed above, certain embodiments provide compositions, particularly pharmaceutical compositions, that comprise, in addition to the GITR antigen binding protein, one or more excipients such as those illustratively described in this section and elsewhere herein. Excipients can be used in the invention in this regard for a wide variety of purposes, such as adjusting physical, chemical, or biological properties of formulations, such as adjustment of viscosity, to improve effectiveness and or to stabilize formulations of GITR antigen binding proteins against degradation due to, for instance, stresses that occur during manufacturing, shipping, storage, pre-use preparation, administration, and thereafter.

In certain embodiments, for instance, free amino acids can be used in GITR antigen binding protein formulations as bulking agents, stabilizers, and antioxidants. As an example, lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Some compositions include a polyol. Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations.

Certain compositions include mannitol as a stabilizer. It is generally used with a lyoprotectant, e.g., sucrose. Sorbitol and sucrose are useful for adjusting tonicity and as stabilizers to protect against freeze-thaw stresses during transport or the preparation of bulk product during the manufacturing process. PEG is useful to stabilize proteins and as a cryoprotectant and can be used in the invention in this regard.

Surfactants can also be included in certain GITR antigen binding protein formulations. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce such surface adsorption. Surfactants also are commonly used to control protein conformational stability. Suitable surfactants include polysorbate 20, polysorbate 80, other fatty acid esters of sorbitan polyethoxylates, and poloxamer 188.

In some embodiments, one or more antioxidants are included in GITR antigen binding protein formulations. Antioxidant excipients can be used to prevent oxidative degradation of proteins. Reducing agents, oxygen/free-radical scavengers, and chelating agents are useful antioxidants in this regard. Antioxidants typically are water-soluble and maintain their activity throughout the shelf life of a product. EDTA is another useful antioxidant that can be included in the formulation.

Formulations may include metal ions that are protein co-factors and that are necessary to form protein coordination complexes. Metal ions also can inhibit some processes that degrade proteins. For example, magnesium ions (10-120 mM) can be used to inhibit isomerization of aspartic acid to isoaspartic acid.

One or more preservatives can be included in certain formulations of GITR antigen binding proteins. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol.

The formulation components are present preferably in concentrations that are acceptable to the site of administration. In certain embodiments, buffers are used to maintain the composition at physiological pH or at a slightly lower pH, typically within a pH range of from about 5 to about 8.

The pharmaceutical compositions can be selected for parenteral delivery. Alternatively, the compositions may be selected for inhalation or for delivery through the digestive tract, such as orally. Preparation of such pharmaceutically acceptable compositions is within the skill of the art.

When parenteral administration is contemplated, the therapeutic compositions may be provided in the form of a pyrogen-free, parenterally acceptable aqueous solution comprising the desired GITR antigen binding protein in a pharmaceutically acceptable vehicle. A particularly suitable vehicle for parenteral injection is sterile distilled water in which the GITR antigen binding protein is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antigen binding protein.

Certain pharmaceutical compositions are formulated for inhalation. In some embodiments, GITR antigen binding proteins are formulated as a dry, inhalable powder. In specific embodiments, GITR antigen binding protein inhalation solutions may also be formulated with a propellant for aerosol delivery. In certain embodiments, solutions may be nebulized. Pulmonary administration and formulation methods therefore are further described in International Patent Application No. PCT/US94/001875, which is incorporated by reference and describes pulmonary delivery of chemically modified proteins.

Some formulations can be administered orally. GITR antigen binding proteins that are administered in this fashion can be formulated with or without carriers customarily used in the compounding of solid dosage forms such as tablets and capsules. In certain embodiments, a capsule may be designed to release the active portion of the formulation at the point in the gastrointestinal tract when bioavailability is maximized and pre-systemic degradation is minimized Additional agents can be included to facilitate absorption of the GITR antigen binding protein. Diluents, flavorings, low melting point waxes, vegetable oils, lubricants, suspending agents, tablet disintegrating agents, and binders may also be employed.

Some pharmaceutical compositions comprise an effective quantity of one or a plurality of GITR antigen binding proteins in a mixture with non-toxic excipients that are suitable for the manufacture of tablets. By dissolving the tablets in sterile water, or another appropriate vehicle, solutions may be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions will be evident to those skilled in the art, including formulations involving GITR binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481, each of which is incorporated by reference), copolymers of L-glutamic acid and gamma ethyl-L-glutamate (Sidman et al., 1983, Biopolymers 2:547-556), poly (2-hydroxyethyl-inethacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. Kits for producing a single-dose administration unit are also provided. Certain kits contain a first container having a dried protein and a second container having an aqueous formulation. In certain embodiments, kits containing single and multi-chambered pre-filled syringes (e.g., liquid syringes and lyosyringes) are provided. The therapeutically effective amount of a GITR antigen binding protein-containing pharmaceutical composition to be employed will depend, for example, upon the therapeutic context and objectives. One skilled in the art will appreciate that the appropriate dosage levels for treatment will vary depending, in part, upon the molecule delivered, the indication for which the GITR antigen binding protein is being used, the route of administration, and the size (body weight, body surface or organ size) and/or condition (the age and general health) of the patient. In certain embodiments, the clinician may titer the dosage and modify the route of administration to obtain the optimal therapeutic effect.

In certain formulations, an antigen binding protein has a concentration of at least 10 mg/ml, 20 mg/ml, 30 mg/ml, 40 mg/ml, 50 mg/ml, 60 mg/ml, 70 mg/ml, 80 mg/ml, 90 mg/ml, 100 mg/ml or 150 mg/ml. In one embodiment, a pharmaceutical composition comprises the antigen binding protein, a buffer and polysorbate. In other embodiments, the pharmaceutical composition comprises an antigen binding protein, a buffer, sucrose and polysorbate. One example of a pharmaceutical composition is one containing 50-150 mg/ml of antigen binding protein, 5-20 mM sodium acetate, 5-10% w/v sucrose, and 0.002-0.04% w/v polysorbate. Other pharmaceutical compositions contain 50-100 mg/ml of antigen binding protein, 5-20 mM sodium acetate, 5-10% w/v sucrose, and 0.002-0.008% w/v polysorbate. Certain, compositions, for instance, contain 65-75 mg/ml of an antigen binding protein in 9-11 mM sodium acetate buffer, 8-10% w/v sucrose, and 0.009-0.011% w/v polysorbate. The pH of certain such formulations is in the range of 4.5-6. Other formulations have a pH of 4.9-5.5 (e.g., pH of 5.0, 5.2 or 5.4).

Dosing frequency will depend upon the pharmacokinetic parameters of the particular GITR antigen binding protein in the formulation used. Typically, a clinician administers the composition until a dosage is reached that achieves the desired effect. The composition may therefore be administered as a single dose, or as two or more doses (which may or may not contain the same amount of the desired molecule) over time, or as a continuous infusion via an implantation device or catheter. Appropriate dosages may be ascertained through use of appropriate dose-response data. In certain embodiments, the antigen binding proteins can be administered to patients throughout an extended time period. In certain embodiments, the antigen binding protein is dosed every two weeks, every month, every two months, every three months, every four months, every five months, or every six months.

The route of administration of the pharmaceutical composition is in accord with known methods, e.g., orally, through injection by intravenous, intraperitoneal, intracerebral (intra-parenchymal), intracerebroventricular, intramuscular, intra-ocular, intraarterial, intraportal, or intralesional routes; by sustained release systems or by implantation devices. In certain embodiments, the compositions may be administered by bolus injection or continuously by infusion, or by implantation device.

The composition also may be administered locally via implantation of a membrane, sponge or another appropriate material onto which the desired molecule has been absorbed or encapsulated. In certain embodiments, where an implantation device is used, the device may be implanted into any suitable tissue or organ, and delivery of the desired molecule may be via diffusion, timed-release bolus, or continuous administration.

In certain embodiments, the composition is administered every 3 weeks by IV infusion, with an initial cycle of 12 weeks. In other embodiments, the composition is administered once every 2-4 weeks by IV infusion with an initial cycle of 12 weeks.

It also may be desirable to use GITR antigen binding protein pharmaceutical compositions according to the disclosed ex vivo. In such instances, cells, tissues or organs that have been removed from the patient are exposed to GITR antigen binding protein pharmaceutical compositions after which the cells, tissues and/or organs are subsequently implanted back into the patient.

EXAMPLES

The following examples, including the experiments conducted and the results achieved, are provided for illustrative purposes only and are not to be construed as limiting the scope of the appended claims.

Example 1

Assays

GITR Binding Assays

GITR Binding Assay 1—Unlabeled Antibody:

Primary human peripheral blood T cells were cultured in growth medium in the presence of plate-bound anti-human CD3 (clone OKT3) for 48-72 hours at 37 C to upregulate GITR expression. Cells were collected and washed and then incubated at 4 C with titrations of the anti-human GITR antibodies or a human IgG1 isotype control antibody. After washing, cells were stained at 4 C with fluorochrome conjugated anti-human CD4 and anti-human CD25 antibodies to identify activated CD4+ effector T cells and with fluorochrome-conjugated anti-huIgG to detect bound anti-human GITR antibodies. The mean fluorescence intensity (MFI) of the anti-human GITR antibodies bound to CD25+ CD4+ cells was determined by flow cytometry. The EC50s of the binding curves were calculated using GraphPad Prism® software.

GITR Binding Assay 2—Labeled Antibody:

Primary human peripheral blood T cells were cultured in growth medium in the presence of plate-bound anti-human CD3 (clone OKT3) for 48-72 hours at 37 C to upregulate GITR expression. Cells were collected and washed and then incubated at 4 C with titrations of the fluorochrome-conjugated anti-human GITR antibodies or a fluorochrome-conjugated human IgG1 isotype control antibody and fluorochrome-conjugated anti-human CD4 and anti-human CD25 antibodies to identify activated CD4+ effector T cells. The mean fluorescence intensity (MFI) of the anti-human GITR antibodies bound to CD25+CD4+ cells was determined by flow cytometry. The EC50s of the binding curves were calculated using GraphPad Prism software.

T Cell Activation Assays

Plate Bound Assays:

This assay was designed to test the ability of an anti-human GITR monoclonal antibody to activate either human or cynomolgous monkey peripheral blood T cells in the presence of TCR stimulation. High binding 96-well plates were coated with 1 ug/mL anti-CD3 (human: clone OKT3; cyno: clone SP34-2) and 0.3 ug/mL anti-human IgG. Titrations of the anti-human GITR monoclonal antibody or a human IgG1 isotype control antibody were added to the wells and incubated at 37 C for 30 minutes to allow capture by the plate-bound anti-human IgG. This capture enabled cross-linking of the antibody, which, as described in greater detail below, is important for antibody activity. Human or cynomolgous monkey T cells were added to the wells and plates were incubated at 37 C for a total of 96 hours. Culture supernatants were collected and assayed for IFNg by ELISA as a measure of anti-human GITR antibody dependent T cell activation. Cells were pulsed with 1 uCi/well 3H for the last 18 hours of culture to evaluate anti-human GITR antibody dependent cell proliferation.

Example 2

Preparation of Fully Human GITR Monoclonal Antibodies

Immunization and Titer Analysis

Antibodies to GITR (SEQ ID NO:1), were raised in multiple different strains of XenoMouse® animals (Abgenix, Fremont, Calif.), which are mice containing human immunoglobulin genes, as well as different immunization strategies. Three harvests of different XenoMouse® animals were used to produce antibodies to human GITR. The first harvest included mice of the XenoMouse® strain XMG2-K, which produces fully human IgG2a antibodies and the XenoMouse® strain XMG4-KL, which produce fully human IgG4κ and IgG4λ antibodies. The second harvest included mice of the XenoMouse® strain XMG2-K, which produces fully human IgG2κ antibodies and the XenoMouse® strain XMG1-KL, which produce fully human IgG1κ and IgG1λ antibodies. The third harvest included only mice of the XenoMouse® strain XMG4-KL, which produce fully human IgG4κ and IgG4λ antibodies. The harvest 1 mice were immunized with CHO cells transiently over-expressing human GITR. The harvest 2 mice were immunized with a human GITR-Fc fusion protein. The harvest 3 mice were immunized with a DNA expression vector encoding the human GITR molecule.

The harvest 1 mice were injected with antigen twice a week over a 5 week time period through either a protocol involving an alternating IP boost followed by a subcutaneous boost at the base of the tail or a protocol with all boosts delivered through subcutaneous injection. The first boost was a total of 4 million transfected cells and all subsequent boosts were done with 2 million transfected cells with either Alum or Alum/CpG as adjuvants. The last boost did not have any additional adjuvants and the cells were immunized directly in PBS. The mice from harvest 2 were initially immunized with 10 µg of antigen delivered through subcutaneous injection and all subsequent boosts were performed with 5 ug doses. The subcutaneous injections were mixed with Alum (aluminum phosphate) and CpG oligos twice a week for 5 weeks. The last boost did not have any additional adjuvants and the protein was immunized directly in PBS. The harvest 3 mice were immunized with gold particles coated with DNA encoding GITR, murine GM-CSF and CpG. The mice were immunized through the abdomen twice a week for a total of 5 weeks. The final boost was done with 2 million CHO cells transiently expressing GITR in PBS.

The protocol used to titer the XenoMouse® animals was as follows: HEK293 cells were transiently transfected with a cDNA construct encoding human GITR or an empty vector control (mock) using 293fectin (Invitrogen) as per manufacturers recommendations. After 24 hrs, the mock transfected cells were labelled with CFDA, SE (Invitrogen) and then mixed in a 1:1 ratio with the GITR-transfected cells. XenoMouse® sera from the immunized animals were diluted to 1:100 in FACS buffer (PBS with 2% FBS) and added to the cell mixture for 1 hr on ice. The cells were then washed twice to remove unbound antibody with FACS buffer prior to the addition of 5 ug/mL of a goat anti-human IgG Fc secondary conjugated with Cy5. The cells were washed with FACS buffer an additional time to remove unbound secondary antibody and then the fluorescent signal on the cells was determined by FACS analysis on a BD FACSCalibur instrument. The animals with the highest geomean signal for the GITR-transfectants versus the mock-transfectants were selected for harvest. This included a total of 6 animals for harvest 1 (3 XMG2-K and 3 XMG4-KL), 6 animals for harvest 2 (2 XMG1-KL and 4 XMG2-K) and 20 animals for harvest 3 (XMG4-KL).

Recovery of Lymphocytes, B-Cell Isoaltions, Fusions and Generation of Hybridomas Selected immunized mice were sacrificed by cervical dislocation and the draining lymph nodes and splenic tissue were harvested and pooled from each cohort. The B cells were isolated from the lymphoid tissue, and the cells were suspended in DMEM. The cells were counted, and 0.9 ml DMEM per 100 million lymphocytes was gently added to resuspend the cell pellet.

Lymphocytes were mixed with non-secretory myeloma at a ratio of 1:4. The cell mixture was gently pelleted by centrifugation at 400×g 4 min. After decanting of the supernatant, the cells were gently mixed using a 1 ml pipette. Preheated PEG/DMSO solution from Sigma (cat# P7306) (1 ml per million of B-cells) was slowly added with gentle agitation over 1 min followed by 1 min of mixing. Preheated IDMEM (2 ml per million B cells) (DMEM without glutamine, L-glutamine, pen/strep, MEM non-essential amino acids (all from Invitrogen)), was then added over 2 minutes with gentle agitation. Finally preheated IDMEM (8 ml per million B-cells) was added over 3 minutes.

The fused cells were spun down 400×g 6 min and resuspended in 20 ml selection media (DMEM (Invitrogen), 15% FBS (Hyclone), supplemented with L-glutamine, pen/strep, MEM Non-essential amino acids, Sodium Pyruvate, 2-Mercaptoethanol (all from Invitrogen), HA-Azaserine Hypoxanthine and OPI (oxaloacetate, pyruvate, bovine insulin) (both from Sigma) and IL-6 (Boehringer Mannheim)) per million B-cells. Cells were incubated for 20-30 min at 37 C and then resuspended in 200 ml selection media and cultured for 3-4 days in a T175 flask prior to 96 well plating to generate hybridomas that produced GITR antibodies.

Example 3

Initial Selection of GITR Antibodies

The GITR antibodies that were obtained as described in Example 2 were then subjected to a variety of preliminary screens to identify potential candidates having the desired combination of binding and functional activities. The antibodies were initially screened for their ability to bind human GITR. Harvest 1, harvest 2 and harvest 3 had 260, 108 and 2119 antigen-specific antibodies identified by FMAT or FACS, respectively, for a total of 2567 GITR-binding antibodies. These antibodies were then further tested to identify those with desired functional activity, including ability to activate T cells and cross-reactivity with cymomolgus GITR.

To determine their ability to activate T cells, the anti-GITR antibodies were tested for their ability to deliver a co-stimulatory signal to T cells in conjunction with TCR signaling via anti-CD3. T cell activation was measured by secretion of IFN-gamma and/or proliferation. The first two harvests were polyclonal for antigen-specific hybridomas, so the functional assay was run with or without exogenous cross-linker in solution to address if the antibody could deliver a biological signal without clustering. The third harvest was plated clonally, so the assay could be run with a low concentration of anti-human IgG Fc capture antibody in each well to effectively normalize the antigen-specific antibody in each well for the bioassay screening. It was determined that cross linking of antibody was required for all FcgR dependent IFNg secretion. Also, the clonality of this antibody panel allowed sequence analysis of a large panel of the active antibodies to aid in lead selection. The antibodies were also tested for their ability to bind to cynomolgus GITR on either primary cynomolgus T cells (harvest 1 and 2) or on the HSC-F cell line (harvest 3) that had been pre-stimulated with anti-CD3. Additional details of these binding and functional assays follow.

Primary Screen

A primary screen for antibodies which bind to wild-type GITR was performed. The initial and confirmatory binding screens were performed by FMAT on all harvests. The general protocol for the primary screen was as follows:

HEK293 cells were transiently transfected with human GITR 24 hrs prior to the day of screening using 293Fection according to the manufacturer's recommended protocol. The exhausted hybridoma supernatants to be tested for the presence of anti-GITR antibodies (20 ul/well) were added to each well of a 96 well plate. Next, 4000 cells transfected with human GITR and 12000 mock transfected cells were added to each well in 40 uL. The secondary antibody (Gt anti-HuIgG Fc Cy5 (Jackson cat#: 109-175-098)) was then added to the wells containing the cells and hybridoma supernatants in 40 uL such that the final concentration of secondary antibody was 1 ug/mL. The samples were incubated for 3 hrs at room temperature and then read out on the FMAT 8200 instrument. A Mo anti-GITR/TNFSF18 antibody (R&D cat#: MAB689) was titrated 1:2 from 10 ug/mL as a positive control for binding in the assay. The binding of this antibody was performed with the following secondary antibody (Gt anti-MoIgG Fc Cy5 (Jackson cat#: 115-175-071)).

Functional Assay

T Cell activation assays were conducted as described in Example 1.

Cynomolgus Cross-Reactivity

To address if the anti-GITR antibodies were capable of binding to cynomolgus GITR, the antibodies were tested for their ability to bind to GITR on primary T cells or a cynomolgus T cell line HSC-F after stimulation in in vitro culture to induce GITR expression. Briefly, the cynomolgus peripheral blood mononuclear cells were isolated by Percoll gradient and cultured for 4 days with 1 ug/mL anti-CD3 (FN-18 (Abcam)) in RPMI containing 10% FBS. The HSC-F cells were stimulated for 1 day with 1 ug/mL anti-CD3 (SP-34 (BD)) in RPMI containing 10% FCS. The T cells were incubated initially with the exhausted hybridoma supernatants containing the anti-GITR antibodies for 2 hrs on ice. For primary T cells, the samples were then washed to remove unbound antibody and stained with a cocktail containing a goat anti-human IgG Fc Cy5 (5 ug/mL), anti-CD4 FITC (OKT4 (eBioscience)), anti-CD25 PE (BC96) and 5 ug/mL 7-AAD for 1 hr on ice. For the HSC-F cell line, the samples were washed to remove unbound antibody and then stained with a cocktail containing a goat anti-human IgG Fc Cy5 (5 ug/mL), anti-CD3 FITC (SP-34 (BD)), anti-CD25 PE (BC96) and 5 ug/mL 7-AAD for 1 hr on ice. The samples were then washed to remove unbound antibodies. In both cases, the binding was evaluated by FACS analysis on a BD FACSCalibur Instrument.

Screening Results

Based on the results of the assays described, several hybridoma lines were identified as producing antibodies with desired interactions with GITR. Limiting dilution was used to isolate a manageable number of clones from each line. The clones were designated by hybridoma line number (e.g. 9H6) and clone number (e.g. 9H6.1). In general, no difference among the different clones of a particular line was detected by the functional assays described herein. The isolated clones were each expanded in 50-100 ml of hybridoma media and allowed to grow to exhaustion, (i.e., less than about 10% cell viability). The concentration and potency of the antibodies to GITR in the supernatants of those cultures were determined by ELISA and by in vitro functional testing, as described herein. Based upon the binding and functional assay results, approximately 260 antibodies were selected for further analysis to identify lead antibodies having the best combination of activities.

Example 4

Production of Human Antibodies from Hybridomas

Antibodies were produced from each hybridoma using 50 ml exhaust supernatant and then purified by protein A chromatography. Hybridoma lines were grown in T75 flasks in 20 ml of media (Integra Media). When the hybridoma was nearly confluent in the T75 flasks, it was transferred to an Integra flask (Integra Biosciences, Integra CL1000, cat#90 005). The Integra flask is a cell culture flask that is divided by a membrane into two chambers, a small chamber and a large chamber. A volume of 20-30 ml of hybridoma cells at a minimum cell density of 1×106 cells per ml was placed into the small chamber of an Integra flask in Integra media. Integra media alone (1 L) was placed in the large chamber of the Integra flasks. The membrane separating the two chambers is permeable to small molecular weight nutrients but is impermeable to hybridoma cells and to antibodies produced by those cells. Thus, the hybridoma cells and the antibodies produced by those hybridoma cells were retained in the small chamber.

After one week, media was removed from both chambers of the Integra flask and was replaced with fresh Integra media. The collected media from the small chambers was separately retained. After a second week of growth, the media from the small chamber was again collected. The collected media from week 1 was combined with the collected media from week 2 for each hybridoma line. The resulting collected media sample from the hybridoma line was spun to remove cells and debris (15 minutes at 3000 rpm) and the resulting supernatant was filtered (0.22 um). Clarified conditioned media was loaded onto a Protein A-Sepharose column. Optionally, the media can be first concentrated and then loaded onto a Protein A Sepharose column. Non-specific bindings were removed by an extensive PBS wash. Bound antibody proteins on the Protein A column were recovered by standard acidic antibody elution from Protein A columns (such as 50 mM Citrate, pH 3.0). Aggregated antibody proteins in the Protein A Sepharose pool were removed by size exclusion chromatography or binding ion exchange chromatography on anion exchanger resin such as Q Sepharose resin. Antibody was eluted with a NaCl gradient of 10 mM-500 mM in 25 column volumes. Production of Recombinant Anti-GITR Human Antibodies from Transfected Cells HEK293 cells (used for transient expression) and CHO cells (utilized for stable expression) were transfected with plasmids that encode the heavy and light chains. Conditioned media from transfected cells was harvested and clarified by removing cells and cell debris. Clarified conditioned media was loaded onto a Protein A-Sepharose column. Optionally, the media can first be concentrated and then loaded onto a Protein A Sepharose column. Non-specific bindings were removed by extensive PBS wash. Bound antibody proteins on the Protein A column were recovered by standard acidic antibody elution from Protein A columns (such as 50 mM citrate, pH 3.0). Aggregated antibody proteins in the Protein A Sepharose pool were removed by size exclusion chromatography or binding ion exchange chromatography on anion exchanger resin such as Q Sepharose resin.

Example 5

Sequence Analysis of GITR Antibodies

The nucleic acid sequences for the light and heavy chains of the above approximately 260 antibodies were then determined by Sanger (dideoxy) nucleotide sequencing. Amino acid sequences were then deduced for the nucleic acid sequences.

Once the antibodies had been sequenced, the antibodies were then analyzed on the basis of a number of different sequence and functional criteria to further restrict the number of antibodies that warranted further investigation. For instance, sequences were analyzed for amino acids or combinations of amino acids that might be susceptible to oxidation, deamination, isomerization, acid hydrolysis or have a propensity to cause aggregation. Sequences anticipated to be problematic were excluded. Further selection was based upon the binding, activation and cross-reactivity data obtained as described in Example 3. Based upon an analysis of all these criteria, a total of 19 parental antibodies were selected for still further analysis and modification. The amino acid sequences for the six CDR sequences, variable domains (heavy chain variable domain (VH) and light chain variable domain (VL)) and full length heavy chain (HC) and full length light chain (LC) for each of these parental antibodies is summarized in TABLE 1 by their respective sequence number. Alignments of the parental sequences are provided in FIGS. 8A, 8B, 9A and 9B.

Example 6

Selection of Parental Antibodies on Basis of Functional and Biophysical Properties To inform the decision making process for making an additional selection of appropriate lead antibodies, the selected 19 parental antibodies were further analyzed with respect to a variety of biophysical properties and additional functional analyses. Biophysical analyses included expression titer, purity of monomeric form versus aggregates, stability as measured by differential scanning calorimeter (DSC), and tendency to aggregate upon agitation (aggregation stability). The additional functional analysis included determining GITR binding affinity and ability to activate T cells. Engineered variants of five of the parental antibodies (44C1, 45A8, 49D9, 49E2 and 48A9) were produced early in the analysis, bringing the total number of antibodies subjected to a full analysis to 23.

Human antibody concentration was obtained by binding rate determination to Protein A sensors on a ForteBio Octet. Antibody supernatants were allowed to bind to pre-wet protein A sensors for 120 sec, 30 C at which point the initial binding rate was calculated. This rate was then compared to a purified standard and a calculated concentration was reported. The default "Basic Quantitation with Regeneration" protocol was used on the ForteBio with PBS, pH 7.4 with 0.1% BSA, 0.02% Tween 20, 0.05% sodium azide as the neutralization buffer and 10 mM Glycine, 150 mM Sodium Chloride pH 2.0 as the regeneration buffer.

Differential Scanning calorimetry (DSC) experiments were done on a MicroCal VP-Capillary DSC. The protein concentration in each experiment is about 0.5 mg/mL in 10 mM Sodium Acetate, 9% Sucrose at pH 5. All samples were heated from 20 C to 95 C at a heating rate of 60 C/hour. The thermal transition midpoint (Tm) was determined when 50% of the molecule was unfolded.

Aggregation stability ranking was determined using previously established procedures to rank order candidates based on agitation and thermal stress (Chen, S., et al. (2010) Protein Sci. 19: 1191-12042, and Woodward, J. et al. (2013) Anal. Chem. 85: 6429-6436.).

Cell binding assays and T cell activation assays monitoring IFNg secretion were performed as described in Example 1.

The results of these various analyses conducted with the original parental antibodies are summarized in TABLE 5 below.

TABLE 5

Expression and biophysical parameters of parental GITR antibodies

| ID No. | Ref. No. | Antibody | Titer (mg/L) | Purity (% mono, SEC) | DSC (Tm Fab) | Aggregation Stability Rank | IFNg Secretion EC50 (ng/ml) | IFNg Secretion (Fold over CD3) | Activated human T-cell binding EC50 (ng/ml) |
|---|---|---|---|---|---|---|---|---|---|
| Ab1 | SS-10942 | 1D7 | 53 | 100% | 69.9 | 2 | 0.8 | 2.2 | 24 |
| Ab17 | SS-10943 | 5H7 | 38 | 100% | 76.7 | 1 | 11.3 | 2.9 | 164 |
| Ab18 | SS-10944 | 7A10 | 62 | 100% | 69.8 | 2 | 0.2 | 2.2 | 27 |
| Ab19 | SS-10945 | 9H6 | 43 | 99% | 78.5 | 1 | 0.5 | 1.9 | 26 |
| Ab2 | SS-12413 | 33C9 | 6 | 100% | 69.9 | 3 | 1 | 2.7 | 35 |

TABLE 5-continued

Expression and biophysical parameters of parental GITR antibodies

| ID No. | Ref. No. | Antibody | Titer (mg/L) | Purity (% mono, SEC) | DSC (Tm Fab) | Aggregation Stability Rank | IFNg Secretion EC50 (ng/ml) | IFNg Secretion (Fold over CD3) | Activated human T-cell binding EC50 (ng/ml) |
|---|---|---|---|---|---|---|---|---|---|
| Ab3 | SS-12414 | 33F6 | 4 | 98% | 73.3 | 1 | 0.4 | 2.8 | 53 |
| Ab4 | SS-12415 | 34G4 | 4 | 100% | 74.3 | 1 | 0.2 | 1.9 | 38 |
| Ab5 | SS-12416 | 35B10 | 3 | 99% | 74.1 | 3 | 0.5 | 1.9 | 33 |
| Ab6 | SS-12417 | 41E11 | 5 | 100% | 67.7 | 1 | 0.3 | 2 | 48 |
| Ab8 | SS-12418 | 42A11 | 10 | 100% | 67.1 | 3 | 1.2 | 1.9 | 51 |
| Ab9 | SS-12419 | 44C1 | 52 | 100% | nd | 1 | nd | nd | nd |
| Ab20 | SS-12514 | 44C1 (C107A LC) | 118 | 100% | 72.4 | 1 | 11.4 | 1.6 | 802 |
| Ab10 | SS-12420 | 45A8 | 41 | 96% | nd | 1 | nd | nd | nd |
| Ab21 | SS-12515 | 45A8 (C107A LC) | 108 | 99% | 77.5 | 1 | 0.7 | 1.8 | 102 |
| Ab11 | SS-12421 | 46E11 | 15 | 99% | 75.2 | 3 | 0.9 | 2.2 | 30 |
| Ab12 | SS-12422 | 48H12 | 4 | 100% | 76.2 | 3 | 0.8 | 1.2 | 48 |
| Ab13 | SS-12423 | 48H7 | 21 | 99% | 72.7 | 1 | 0.6 | 1.2 | 45 |
| Ab14 | SS-12424 | 49D9 | 7 | 100% | nd | 1 | nd | nd | nd |
| Ab22 | SS-12562 | 49D9 (R17G HC) | 27 | 100% | 76.7 | 1 | 0.5 | 1.3 | 51 |
| Ab15 | SS-12425 | 49E2 | 40 | 100% | nd | 1 | nd | nd | nd |
| Ab23 | SS-12516 | 49E2 (C107A LC) | 51 | 100% | 64.6 | 2 | 2.2 | 1.9 | 318 |
| Ab16 | SS-12427 | 48A9 | 15 | 98% | nd | 1 | nd | nd | nd |
| Ab24 | SS-12513 | 48A9 (C39Y HC) | 71 | 100% | 77.7 | 1 | 79.1 | 0.9 | 145 |
| Ab7 | SS-12428 | 41G5 | 15 | 99% | 74.2 | 2 | 0.8 | 1.9 | 33 |

Based upon an analysis of the results obtained, a subset of the parental antibodies, antibodies 5H7, 7A10, 9H6, 33C9 and 41G5, were selected for further evaluation and development.

Example 7

Engineering of Subset of Parental GITR Antibodies

The sequences of the five selected parental antibodies were further analyzed to identify residues that might negatively impact activity, stability or pose an immunogenicity risk. With respect to this latter aspect, the sequences were analyzed for the potential to bind HLA class II molecules, as the formation of potential antibody/HLA complexes could drive T lymphocyte-dependent B cell antibody responses. A number of engineered variants of the five selected parental antibodies were subsequently prepared and tested to identify antibodies with improved biophysical and/or functional properties.

The results of the analyses for the engineered variants of the five selected parental antibodies is summarized in TABLE 6. The sequences for the CDRs, variable domains and full length light and heavy chains for those selected variants from TABLE 6 that had activity and expression levels above a certain threshold are summarized in TABLE 1. Alignments of the variable domains of the engineered antibodies are provided in FIGS. 10A, 10B, 11A and 11B.

TABLE 6

Expression and biophysical parameters of engineered versions of selected parental GITR antibodies.

| ID No. | Antibody | Ref. No. | Titer (mg/L) | SEC (% monomer) | Aggregation Stability Rank | Proliferation EC50 (ng/ml) | Proliferation (Fold over CD3) | Binding EC50 (ng/ml) |
|---|---|---|---|---|---|---|---|---|
| 17 | 5H7 | SS-10943 | 20 | 99 | 1 | 8 | 3.4 | 303 |
| 25 | 5H7v1 | SS-16912 | 153 | 96 | 1 | 33 | 1.0 | nd |
| 26 | 5H7v2 | SS-13807 | 119 | 98 | 1 | 11 | 3.2 | 279 |
| 27 | 5H7v3 | SS-16913 | 96 | 95 | 1 | 15 | 3.2 | 293 |
|  | 5H7v4 | SS-16914 | 70 | 92 | 1 | >1000 | 0.0 | >1000 |
| 28 | 5H7v5 | SS-16915 | 48 | 94 | 1 | 21 | 1.4 | >1000 |
|  | 5H7v6 | SS-16916 | 35 | 92 | 1 | >1000 | 0.0 | >1000 |
| 29 | 5H7v7 | SS-16917 | 18 | 97 | 1 | 28 | 2.1 | 461 |
|  | 5H7v8 | SS-16918 | 64 | 94 | 2 | >1000 | 0.0 | >1000 |
| 30 | 5H7v9 | SS-16921 | nd | nd | nd | nd | nd | nd |
| 31 | 5H7v10 | SS-16919 | 70 | 98 | 1 | 39 | 0.6 | >1000 |
| 32 | 5H7v11 | SS-16920 | 91 | 98 | 1 | 32 | 2.0 | >1000 |
|  | 5H7v12 | SS-16922 | 68 | 98 | 2 | >1000 | 0.0 | >1000 |

TABLE 6-continued

Expression and biophysical parameters of engineered versions of selected parental GITR antibodies.

| ID No. | Antibody | Ref. No. | Titer (mg/L) | SEC (% monomer) | Aggregation Stability Rank | Proliferation EC50 (ng/ml) | Proliferation (Fold over CD3) | Binding EC50 (ng/ml) |
|---|---|---|---|---|---|---|---|---|
| 33 | 5H7v13 | SS-16923 | 58 | 98 | 1 | 113 | 1.2 | >1000 |
| 34 | 5H7v14 | SS-16924 | 35 | 97 | 1 | 31 | 1.9 | 995 |
|  | 5H7v15 | SS-16925 | 73 | 96 | 1 | >1000 | 0.0 | >1000 |
|  | 5H7v16 | SS-16926 | 78 | 97 | 1 | >1000 | 0.0 | >1000 |
| 35 | 5H7v17 | SS-16927 | 46 | 97 | 1 | 24 | 3.0 | >1000 |
| 36 | 5H7v18 | SS-16928 | 146 | 95 | 1 | 12 | 2.7 | 804 |
| 37 | 5H7v19 | SS-16929 | 0 | nd | nd | nd | nd | nd |
|  | 5H7v20 | SS-16930 | 48 | 93 | 1 | >1000 | 0.0 | >1000 |
|  | 5H7v21 | SS-16931 | 42 | 94 | 1 | >1000 | 0.0 | >1000 |
| 38 | 5H7v22 | SS-16932 | 26 | 95 | 1 | 27 | 1.7 | 786 |
|  | 5H7v23 | SS-16933 | 0 | nd | nd | >1000 | 0.0 | >1000 |
|  | 5H7v24 | SS-16934 | 60 | 95 | 1 | >1000 | 0.0 | >1000 |
|  | 5H7v25 | SS-16935 | 188 | 96 | 1 | >1000 | 0.0 | >1000 |
|  | 5H7v26 | SS-16936 | 0 | nd | nd | >1000 | 0.0 | >1000 |
|  | 5H7v27 | SS-16937 | 39 | 94 | 1 | >1000 | 0.0 | >1000 |
| 18 | 7A10 | SS-10944 | 149 | 97 | 2 | 12 | 3.4 | 67 |
| 39 | 7A10v1 | SS-13810 | 186 | 99 | 2 | 3 | 3.0 | 56 |
| 40 | 7A10v2 | SS-16938 | 86 | 99 | 1 | 43 | 0.7 | 861 |
| 41 | 7A10v3 | SS-16939 | 185 | 98 | 2 | 46 | 55.0 | 3 |
| 42 | 7A10v4 | SS-16940 | 163 | 99 | 2 | 6 | 60.0 | 2 |
| 43 | 7A10v5 | SS-16941 | 115 | 99 | 1 | 20 | 0.6 | 783 |
|  | 7A10v6 | SS-16942 | 0 | nd | nd | >1000 | 0.0 | >1000 |
| 19 | 9H6 | SS-10945 | 49 | 97 | 2 | 7 | 3.0 | 134 |
| 44 | 9H6v1 | SS-16943 | 33 | 95 | 2 | 4 | 3.2 | 144 |
| 45 | 9H6v2 | SS-16944 | 103 | 92 | 1 | 19 | 2.2 | 423 |
| 46 | 9H6v3 | SS-13806 | 72 | 94 | 1 | 6 | 3.7 | 90 |
| 47 | 9H6v4 | SS-16945 | 121 | 95 | 2 | 7 | 3.3 | 95 |
| 48 | 9H6v5 | SS-16946 | 52 | 92 | 1 | 11 | 1.9 | 380 |
| 49 | 9H6v6 | SS-16947 | 109 | 94 | 1 | 11 | 1.5 | 411 |
| 2 | 33C9 | SS-12413 | 88 | 94 | 3 | 10 | 2.7 | 60 |
| 50 | 33C9v1 | SS-16948 | 6 | nd | nd | 18 | 2.1 | 78 |
| 51 | 33C9v2 | SS-13808 | 155 | 99 | 3 | 7 | 2.9 | 60 |
| 52 | 33C9v3 | SS-16949 | 141 | 99 | 3 | 25 | 3.1 | 56 |
| 53 | 33C9v4 | SS-16950 | 18 | 98 | 2 | 17 | 2.6 | 82 |
| 54 | 33C9v5 | SS-16951 | 30 | 96 | 3 | 18 | 2.5 | 68 |
| 7 | 41G5 | SS-12428 | 18 | 96 | 2 | 4 | 3.7 | 55 |
| 55 | 41G5v1 | SS-16952 | 27 | 92 | 2 | 17 | 2.9 | 60 |
| 56 | 41G5v2 | SS-13809 | 110 | 95 | 2 | 3 | 3.5 | 57 |
| 57 | 41G5v3 | SS-16953 | 53 | 96 | 2 | 7 | 3.4 | 60 |
| 58 | 41G5v4 | SS-16954 | 113 | 93 | 1 | 15 | 2.2 | 68 |
| 59 | 41G5v5 | SS-16955 | 68 | 94 | 1 | 12 | 2.5 | 64 |

From an analysis of the collected data on the engineered variants, 5 of the variants (9H6v3, 7A10v1, 5H7v2, 41G5v2, 33C9v2) were selected for further biophysical and functional analysis and scaled-up production. A summary of biophysical parameters analyzed is provided in TABLE 7; functional data for the selected variants is summarized in TABLE 8 for antibodies after scale-up production.

TABLE 7

Summary of biophysical properties of selected variants after scale-up production

| Antibody | 9H6v3 | 7A10v1 | 5H7v2 | 41G5v2 | 33C9v2 |
|---|---|---|---|---|---|
| ID | SS-13806 | SS-13810 | SS-13807 | SS-13809 | SS-13808 |
| Calculated pI | 9.46 | 9.1 | 8.64 | 9.12 | 8.98 |
| Expression Titer (mg/L) | 46 mg/L | 72 mg/L | 39 mg/L | 45 mg/L | 25 mg/L |
| SEC % Monomer (Protein A) | 93% | 97% | 96% | 94% | 99% |
| SEC % Monomer (Final Product) | 99% | 99% | 97% | 99.3 | 99% |
| Purification Yield % | 75% | 81% | 96% | 75% | 87% |
| Tm (DSC) | 81.1° | 74.4° | 83.2° | 76.6° | 72.7° |

TABLE 8

Summary of biological attributes of selected variants after scale-up production

| ID | clone | Human T cell Binding EC$_{50}$ (ng/mL) | Cyno T cells Binding EC$_{50}$ (ng/mL) | Cyno: Hu Binding EC$_{50}$ Ratio | Activation EC$_{50}$ ng/mL (IFNg secretion) | proliferation (fold over CD3) | Blocks GITR-L Binding | FcgR mediates activation of hu T cells (proliferation) | Mediates GITR internalization |
|---|---|---|---|---|---|---|---|---|---|
| SS-13806 | 9H6v3 | 26 | 184 | 7.1 | 0.06 | 3.7 | Y | Y | Y |
| SS-13807 | 5H7v2 | 164 | 619 | 3.7 | 1.6 | 3.2 | Y | Y | Y |
| SS-13808 | 33C9v2 | 35 | 301 | 8.6 | 0.86 | 2.9 | Y | Y | Y |
| SS-13809 | 41G5v2 | 33 | 153 | 4.6 | 0.64 | 3.5 | Y | Y | Y |
| SS-13810 | 7A10v1 | 27 | 173 | 6.4 | 0.32 | 3 | Y | Y | Y |

Example 8

Selected GITR Antibodies Compete with GITRL

Some of the selected GITR antibodies were tested in a set of cross-competition assays to determine if they competed with GITRL for binding to GITR.

In this set of experiments, a Falcon 100 mm dish (BD Facoln #353003) was coated with 5 ml of 10 ug/ml mouse anti-human CD3 antibody OKT3 (eBioscience #16-0037-85) for 4 hours at room temperature. Then the dish was washed twice with PBS. Human pan T cells were isolated from PBMCs using Pan T cell Isolation Kit II (Miltenyi #130-091-156). Fifty million pan T cells in complete medium (PRMI1640, plus 10% FBS, L-glutamine, NEAA, sodium pyruvate, β-mercaptoethanol) were seeded in the dish precoated with CD3 and incubated in 5% CO2 incubator at 37° C. for 4 days to stimulate the T cells to increase GITR expression.

On day 4, pan T cells were harvested and stained with mouse anti-human CD4 PerCP5.5 (BD Biosciences #560650), mouse anti-human CD8 (BD Biosciences #555634), and mouse anti-human CD25 APC (Miltenyi #130-092-858) for 30 min at 4° C. in staining buffer (2% FBS, 0.05% NaN3 in PBS) to identify two different effector cell populations: activated CD4 (CD25+CD4+) and activated CD8 (CD25+CD8+) cells. Then cells were washed twice with staining buffer and 0.5×10$^6$ cells were seeded per well in U-bottom plate for competitive binding.

To evaluate whether anti-human GITR antibodies block GITR ligand (GITR-L, RD #694-GL-CF) binding, a titration of non-conjugated anti-human GITR antibodies from 2-64 nM (clones 9H6, 5H7, 41G5) were incubated with pan T cells at 4° C. in staining buffer for 10 min. Without washing, 4 nM of human GITR-L was added and incubated at 4° C. for another 30 min. Then cells were washed twice with staining buffer, and incubated with anti-his PE (Miltenyi #130-092-691) in staining buffer at 4° C. for 30 min. Then cells were washed twice with staining buffer and fixed with 2% paraformaldehyde in PBS for flow cytometry analysis. The results of this experiment are shown in FIGS. 1A and 1B.

To evaluate whether GITR-L blocks anti-human GITR antibody binding, a titration of non-conjugated human GITR-L from 2-64 nM was incubated with pan T cells at 4° C. in staining buffer for 10 min. Without washing, 4 nM of anti-human GITR antibodies (clones 9H6, 5H7, 41G5) were added and incubated at 4° C. for another 30 min. The cells were washed twice with staining buffer, and incubated with anti-human Fc PE (Jackson Immunoressearch #109-116-170) in staining buffer at 4° C. for 30 min. Then cells were washed twice with staining buffer and fixed with 2% paraformaldehyde in PBS for flow cytometry analysis. FIGS. 1C and 1D show the results of this study.

As can be see from FIGS. 1A and 1B, each of the anti-GITR antibodies tested was able to block GITRL binding to both CD4+ and CD8+ cells. Likewise, FIGS. 1C and 1D demonstrate that GITRL can block each of the GITR antibodies tested from binding CD4+ and CD8+ cells. Collectively, these results illustrate that the GITR antibodies and GITRL cross-compete with one another for binding to GITR.

Example 9

Prevention of Regulatory T Cell-Induced Suppression

An antibody from the selected lead GITR antibodies was tested to determine if such antibodies had the desired activity of preventing regulatory T cell suppression of effector T cell activity. In such experiments, GITR antibody was initially conjugated to Dynabeads as follows. Three hundred micrograms of GITR antibody clone 9H6v3 and human IgG1 isotype control were conjugated to 15 mg of Dynabeads M-270 Epoxy (Invitrogen #143.01), in accordance with the instructions in Dynabeads Antibody Coupling Kit (Invitrogen Cat #413.11D) user manual. Briefly, 0.3 mg of antibody was incubated with 15 mg of beads in 0.75 ml of C1 buffer plus 0.75 ml of C2 buffer at 37° C. with rocking overnight. The next day, the beads were washed with 1.2 ml of HB, LB and SB buffers sequentially according to the manual. After coupling, beads were counted and stored in SB buffer with 0.02% NaN3 at 2×10$^8$ beads/ml at 4° C.

Human CD4 T cells were isolated using the human CD4+ T cell isolation kit (Miltenyi #130-096). Treg cells were further enriched using human CD25 Microbeads II (Miltenyi #130-092-983) following the manufacturer's instructions. The CD25 depleted CD4 T cells were used as T responders in the suppression assay. Treg suppression inspector (a.k.a T cell activation beads, Miltenyi #130-092-909), which are beads conjugated with anti human CD2, CD3 and CD28 antibodies, was used to activate T cells in the assay. On a 96-well plate, 50,000 each of Tregs and T responders were seeded/well, and incubated with equal number of T cell activation beads and a titration of GITR antibody beads for 5 days. The cells were pulsed with 1 uCi of 3H in the last 16 hours, and harvested for 3H counts.

FIG. 2 shows the results of a representative experiment demonstrating that GITR agonistic antibody 9H6v3 can relieve Treg suppression of the activity of effector T cell activity.

Example 10

Antibodies Cause Decrease in Circulating Regulatory T Cells

In addition to the in vitro studies described in Example 9 demonstrating inhibition of T cell suppression, a related in vivo experiment was conducted to determine if certain of the antibodies provided herein were capable of decreasing circulating regulatory T cells in a humanized NSG mouse model.

In this experiment, neonate NSG mice were transplanted with CD34+ fetal liver cells by retroorbital injection. Over 16 weeks, animals developed a diverse human immune cell repertoire including CD4+ and CD8+ effector T cells and regulatory T cells. A single i.p. dose of 25 mg/kg anti-human GITR antibody (9H6v3, 5H7v2 and 41G5v2) or human IgG1 isotype control was given and the % of circulating human CD4+ T cells expressing the regulatory T cell marker FoxP3 was determined by flow cytometry on day 4 after dosing.

Figure 3:
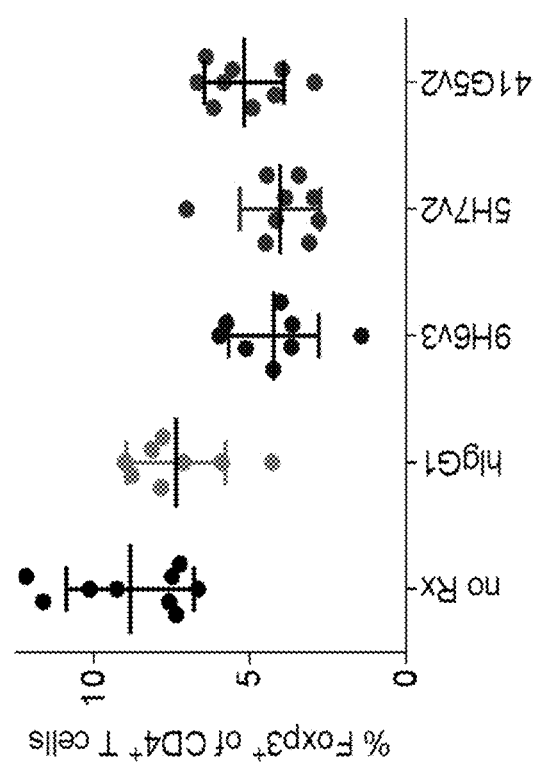
FIG. 3 summarizes results of an experiment that determined that several GITR antibodies such as disclosed herein (9H6v3, 5H7v2 and 41G5v2) cause a decrease in the number of circulating regulatory T cells in a humanized NSG mouse model (non-tumor bearing). In this experiment, NSG mice were induced to produce human CD4+ and CD8+ effector T cells and regulatory T cells by transplanting CD34+ fetal liver cells into the mice. A single intraperitoenal dose of 25 mg/kg GITR antibody was injected into the mice and the percent of circulating human CD4+ T cells expressing the regulatory T cell marker FoxP3 determined by flow cytometry.

As shown in FIG. 3, separately administering each of antibodies 9H6v3, 5H7v2 and 41G5v2 into the humanized mouse model resulted in a decrease in the circulating levels of regulatory T cells relative to control. Such activity is useful in inducing or enhancing an immune response.

Example 11

GITR Antibody Clustering Via FcγR Binding

Several of the lead parental antibodies were tested in vitro to evaluate the ability of the FcgammaReceptor (FcγR), in particular, Fcgamma-RIIa and Fcgamma-RIIIa, to mediate activation of human peripheral blood T cells in the presence of TCR stimulation.

To conduct these experiments, 293T cells were engineered to express either human Fcgamma-RIIa or human Fcgamma-RIIIa. The Fcgamma-R-expressing 293T cells were paraformaldehyde fixed and seeded in 96-well plates at a one to one ratio with human peripheral blood CD4+ T cells. Anti-huCD3 coated beads were added to the culture to provide TCR stimulation. Titrations of the anti-human GITR monoclonal antibodies or a human IgG1 isotype control antibody were added to the wells and cultures were incubated at 37 C for a total of 96 hours. Cells were pulsed with 1 uCi/well 3H for the last 18 hours of culture to evaluate anti-human GITR antibody dependent cell proliferation.

Figures 4A, 4B:
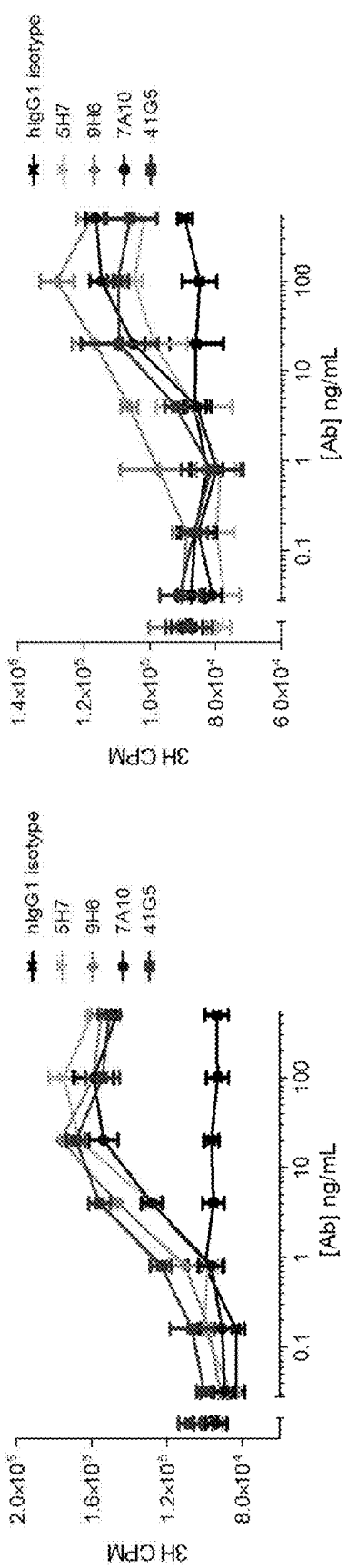
FIGS. 4A and 4B are graphs showing that two different forms of the Fc gamma receptor (FcγR) can cause clustering of GITR antibodies such as those provided herein. The results in FIG. 4A demonstrate that FcγRIIa can cluster representative GITR antibodies (5H7, 9H6, 7A10 and 41G5) to activate primary human T cells in a proliferation assay.

As shown in FIG. 4A, FcγRIIa was found to be capable of clustering each of the lead antibodies to activate primary human T cells. Likewise, FcγRIIIa was also found to have clustering activity (FIG. 4B). The graphs in each figure represent mean±StdDev of triplicate wells and are representative of 5 experiments from 5 human donors. These results demonstrate that Fcgamma receptors can provide the cross-linking required for anti-human GITR antibody-mediated activation of T cells. FcgR-bearing cells provide the clustering of GITR Abs required for signaling through GITR. Fcg receptor binding to GITR Abs is also required for ADCC. These results have important implications for the biology underlying the antibody activity. Binding of the antibody to GITR is not sufficient to activate GITR. Without binding to the Fc receptor as demonstrated in this example, because the antibody will trigger GITR signaling unless it is aggregated.

Example 12

Differential Binding of GITR Antibodies to Human T Cell Subsets

Some of the parental antibodies that were obtained were tested for their ability to bind different subsets of human T cells and compared with to antibody 6C8 as described in WO 06/105021.

To perform these experiments, a Falcon 100 mm dish (BD Facoln #353003) was coated with 5 ml of 10 ug/ml mouse anti-human CD3 antibody OKT3 (eBioscience #16-0037-85) for 4 hours at room temperature. Then the dish was washed twice with PBS. Human pan T cells were isolated from PBMCs using the Pan T cell Isolation Kit II (Miltenyi, #130-091-156). Fifty million pan T cells in complete medium (PRMI1640, plus 10% FBS, L-glutamine, NEAA, sodium pyruvate, β-mercaptoethanol) were seeded in the pre-coated dish and incubated in 5% CO2 incubator at 37° C. for 4 days.

On day 4, pan T cells were harvested and stained with mouse anti-human CD4 PerCP5.5 (BD Biosciences #560650), mouse anti-human CD8 (BD Biosciences #555634), and mouse anti-human CD25 APC (Miltenyi #130-092-858) for 30 min at 4° C. in staining buffer (2% FBS, 0.05% NaN3 in PBS). Then cells were washed twice with staining buffer and $0.5 \times 10^6$ cells were seeded per well in U-bottom plate.

A titration of anti-human GITR antibodies (clones 9H6, 5H7, 41G5), as well as antibody 6C8, from 2-64 nM was incubated with pan T cells at 4° C. in staining buffer for 30 min. Then cells were washed twice with staining buffer, and incubated with anti-human Fc PE (Jackson Immuneres-search #109-116-170) in staining buffer at 4° C. for 30 min. The cells were subsequently washed twice with staining buffer and fixed with 2% paraformaldehyde in PBS for flow cytometry analysis.

Similar Experiments were Conducted with GITRL.

Figure 5A:
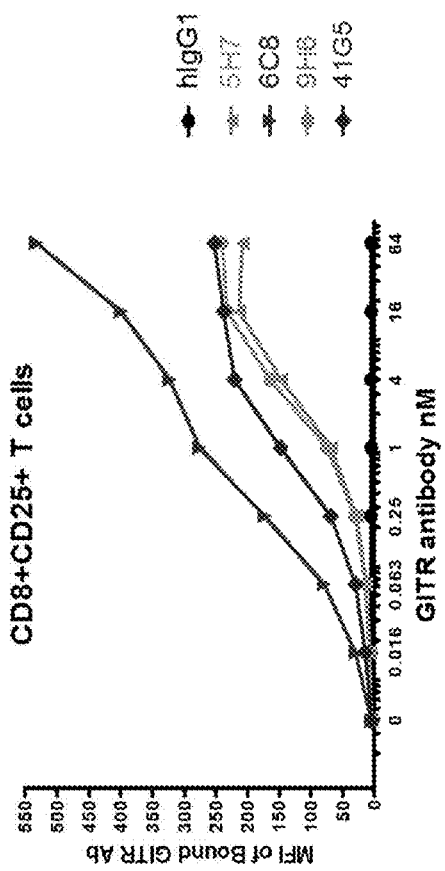
FIGS. 5A-5D summarize results from experiments demonstrating that certain GITR antibodies such as those disclosed herein differentially bind to 4 different subpopulations of human T cells. In particular, the results show that three antibodies described herein (5H7, 9H6 and 41G5) 1) bind CD4+CD25+ T cells but not CD4+CD25− T cells (FIGS. 5A and 5B), and 2) bind CD8+CD25+ T cells but not CD8+CD25− T cells (FIGS. 5C and 5D). These results contrast with those obtained for another known GITR antibody which 1) also binds CD4+CD25+ T cells but not CD4+CD25− T cells, but 2), unlike 5H7, 9H6 and 41G5, can bind both CD8+CD25+ T cells and CD8+CD25− T cells. In each graph, mean fluorescent intensity (MFI) is plotted relative to antibody concentration (nM). Details of the experiment are provided in Example 12.
Figure 5B:
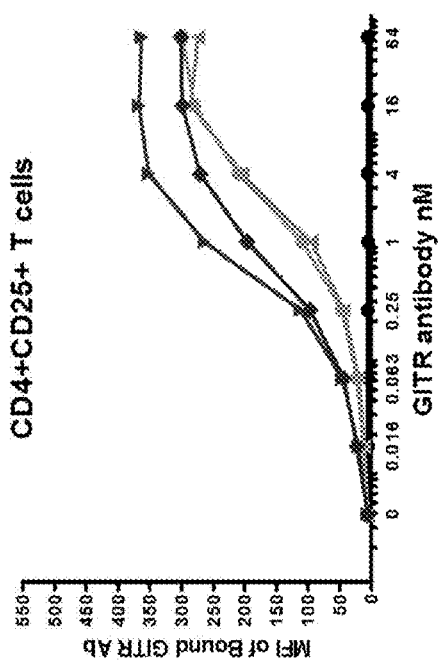
Figure 5C:
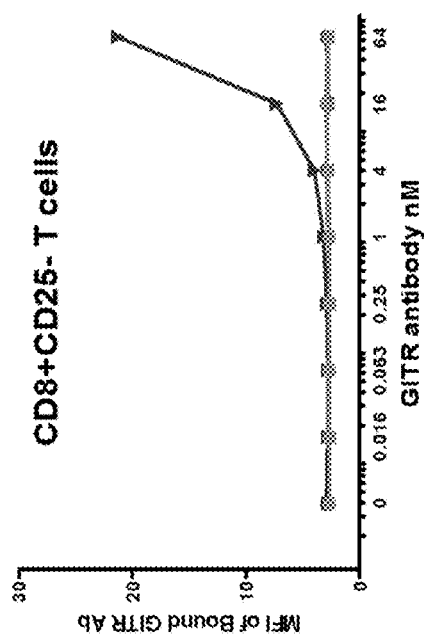
Figure 5D:
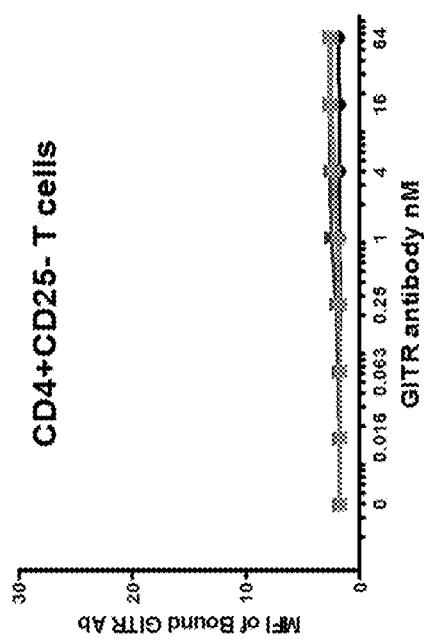
Figure 6:
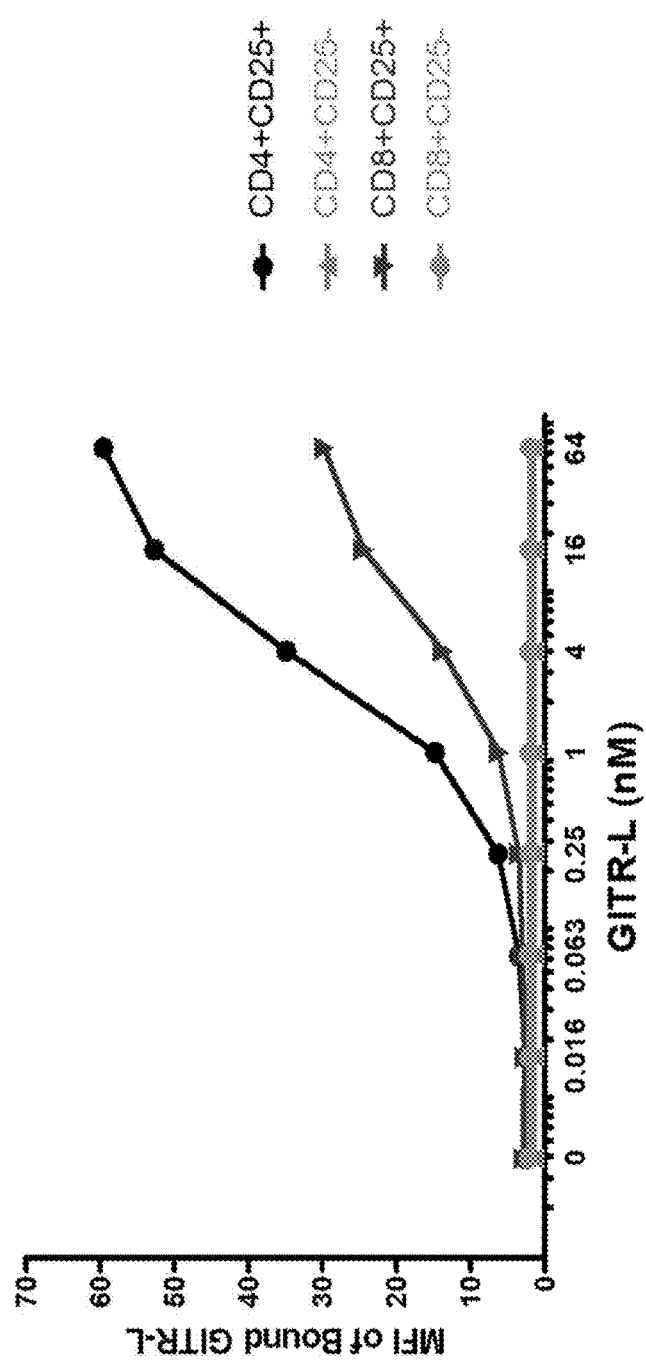
FIG. 6 provides a graph of the results from an experiment similar to that described with respect to FIGS. 5A-D, except that the experiment was conducted with GITRL rather than GITR antibodies. The results show that GITRL, like antibodies 5H7, 9H6 and 41G5, 1) binds CD4+CD25+ T cells but not CD4+CD25− T cells, and 2) binds CD8+CD25+ T cells but not CD8+CD25− T cells. Thus, the selectivity of binding observed with 5H7, 9H6 and 41G5 is similar to that observed with the natural ligand.

The results of the GITR Ab binding are summarized in FIGS. 5A-5D. Corresponding results with GITRL are shown in FIG. 6. As can been seen from these figures, antibodies 5H7 and 9H6 as disclosed herein, as well as 6C8, each bind CD4+CD25+ T cells (FIG. 5A), and also bind CD8+CD25+ T cells (FIG. 5C). However, whereas 6C8 can bind CD8+ CD25− T cells, 5H7 and 9H6 bind only at very low levels, if at all (FIG. 5D). None of the antibodies tested bound CD4+CD25− T cells (FIG. 5B). Thus, 5H7 and 9H6 show similar selectivity in T cell binding and bind differentially to different human T cell subsets.

As illustrated in FIG. 6, GITRL also shows differential binding to human T cell subsets. Like antibodies 5H7 and 9H6, it can bind CD4+CD25+ T cells and CD8+CD25+ T cells, but, also similar to 5H7 and 9H6, binds with significantly lower affinity to CD4+CD25-T cells and CD8+ CD25− T cells. Thus, the selectivity in binding exhibited by 5H7 and 9H6 is similar to that observed for GITRL, the natural ligand.

Example 13

Internalization of GITR Antibodies into Human CD4 Cells

A set of experiments were conducted to determine whether several of the parental antibodies could be internalized by human CD4 cells. For comparison, antibody 6C8 as described in WO 06/105021 was also tested.

The trials were initiated by coating a Falcon 100 mm dish (BD Facoln #353003) with 5 ml of 10 ug/ml mouse anti-human CD3 antibody OKT3 (eBioscience #16-0037-85) for 4 hours at room temperature. Then the dish was washed twice with PBS. Human CD4+ T cells were isolated from PBMCs using CD4+ T cell Isolation Kit (Miltenyi Biotec, #130-096-533). Fifty million pan T cells in complete medium (PRMI1640, plus 10% FBS, L-glutamine, NEAA, sodium pyruvate, β-mercaptolethanol) were seeded in the pre-coated dish and incubated in 5% CO2 incubator at 37° C. for 4 days.

On day 4, CD4+ T cells were harvested and $0.5 \times 10^6$ cells per well were seeded in 96-well U-bottom plate. CD4+ cells were incubated with Alexa-488 or Alexa-647 conjugated anti-human GITR antibody at 10 ug/ml in complete medium at 4° C. for 30 min. Then the cells were washed twice with complete medium and incubated in a 5% CO2 incubator at 37° C. for 0, 1, 2, 4 and 24 hours. At the end of incubation, the cells were collected. The cells in each well were equally split to two wells. Cells in one well were incubated with 150 ul acidic buffer (10% FBS, 0.5M NaCl, 0.2M acetic acid, pH 2.5) at 4° C. for 5 min, while the cells in other well were incubated with complete medium. At the end of incubation, both wells were washed with complete medium three times and stained with anti-human CD25 APC (Miltenyi Biotec, #130-092-858) or anti-human CD25 PE (Miltenyi Biotec, #130-091-024) in staining buffer at 4° C. for 30 min. The cells were subsequently washed twice, and fixed with 2% paraformaldehyde in PBS for FACS calibur analyses.

Figure 7:
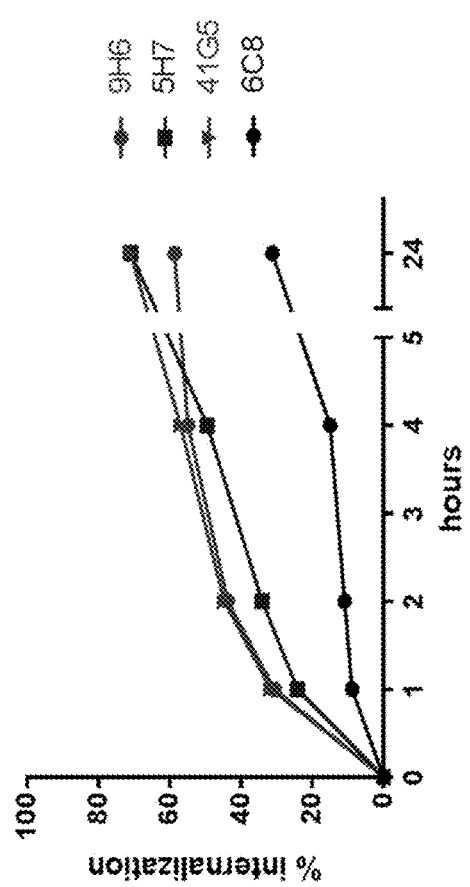
FIG. 7 is a plot showing that antibodies such as provided herein (9H6, 5H7, and 41G5) are internalized into primary human CD4+ cells. In contrast, another known antibody shows significantly less internalization. In the experiments, CD4+ cells were placed into wells and then incubated with Alexa-488 or Alexa-647 labeled antibody for 30 minutes. After washing, cells were incubated at 37° C. in 5% $CO_2$ for varying time periods, after which the cells were collected and split equally into two wells. One well was incubated with a solution containing 0.2 M acetic acid, whereas the other well of cells was incubated in complete medium. Following these incubations, the cells were washed and then stained with either anti-human CD25 APC or anti-human CD25 PE in staining buffer for 30 min. The cells were washed, fixed with 2% paraformaldehyde and then analysed by flow cytometry.

The results in FIG. 7 show that antibodies 9H6, 5H7, and 41G5 as disclosed herein all were internalized into human CD4 cells within a 24 hour period. In contrast, antibody 6C8 was internalized to a significantly lower extent.

Example 14

Enhanced Activity of Glycosylated Antigen Binding Proteins

Figure 12B:
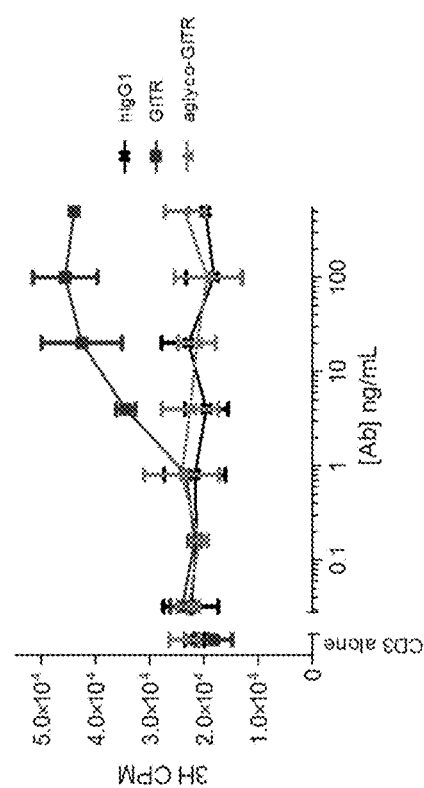
FIGS. 12A and 12B demonstrate the importance of the glycosylation state of the GITR antibodies in activating GITR signaling. Tests were conducted with a native IgG1 GITR antibody which is glycosylated and an IgG1 GITR antibody engineered to have an asparagine to glutamine amino acid substitution at position 297 which eliminates an N-linked glycosylation site critical for binding of the Fc to Fcgamma receptors. The native and aglycosylated variants were tested for their ability to mediate activation of CD4+ T cells with GITR antibody clustering provided by either Fcgamma-RIIa or Fcgamma-RIIIa.
Figure 12A:
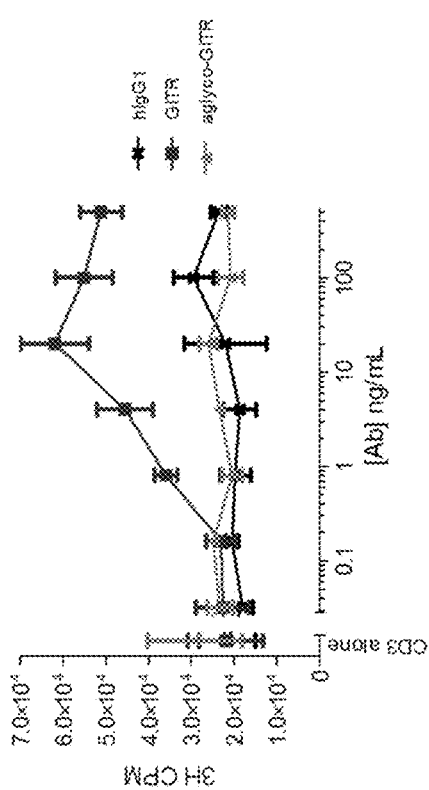

The importance of the glycosylation state of the GITR antibodies was evaluated in an assay where Fcgamma receptors provide the clustering necessary for GITR signaling on CD4+ T cells. A representative native IgG1 GITR antibody was engineered with an asparagine to glutamine amino acid substitution at position 297 which eliminates an N-linked glycosylation site critical for binding of the Fc to Fcgamma receptors. The native and aglycosylated variants were tested for their ability to mediate activation of CD4+ T cells with GITR antibody clustering provided by either Fcgamma-RIIa or Fcgamma-RIIIa. Briefly, 293T cells were engineered to express either human Fcgamma-RIIa or human Fcgamma-RIIIa. The Fcgamma-R-expressing 293T cells were paraformaldehyde fixed and seeded in 96-well plates at a one to one ratio with human peripheral blood CD4+ T cells. Anti-huCD3-coated beads were added to the culture to provide TCR stimulation. Titrations of the native IgG1 variant and the aglycosylated IgG1 variant anti-human GITR antibodies or a human IgG1 isotype control antibody were added to the wells and cultures were incubated at 37 C for a total of 96 hours. Cells were pulsed with 1 uCi/well 3H for the last 18 hours of culture to evaluate anti-human GITR antibody dependent cell proliferation. As seen in FIGS. 12A and 12B, both Fcgamma RIM and RIIIa were able to cluster the native IgG1 GITR antibody and drive proliferation of effector T cells. In contrast, the aglycosylated antibody did not show any activity due to its inability to bind and be clustered by Fcgamma Rs. In vivo, Fcgamma receptors provide the clustering activity required for anti-human GITR antibody-mediated activation of T cells, therefore, the glycosylation state of the GITR antibody is an important factor.

Example 15

Pharmacokinetic and Pharmacodynamic Analysis

Single dose pharmacokinetic and pharmacodynamic (PK/PD) characterization of the antibodies 9H6 and 5H7 were evaluated in naïve male cynomolgus monkeys, with both candidates being tested at 1.0 and 10 mg/kg by bolus intravenous administration. Antibody 9H6 displayed mean half-lives of 181 hours (7.55 days) and 166 hours (6.92 days) at doses of 1 and 10 mg/kg, respectively. Antibody 5H7 displayed mean half-lives of 1301 hours (12.6 days) and 222 hours (9.23 days) at doses of 1 and 10 mg/kg, respectively. Both candidates exhibited linear PK with dose proportional exposure as measured by area under the concentration versus time curve (AUC).

All patents and other publications identified are expressly incorporated herein by reference for the purpose of describing and disclosing, for example, the methodologies described in such publications that might be used in connection with the described. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

SEQUENCE LISTING (450 sequences)

SEQ ID NO: 1 - protein, 241 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 2 - protein, 235 aa, Macaca fascicularis
MCACGTLCCLALLCAASLGQRPTGGPGCGPGRLLLGTGKDARCCRVHPTRCCRDYQSEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEPPGWLTIVLLAVAACVLLLTSAQLGLHIWQLRSQPTGPRETQLLLEVPPSTEDASSCQFPEEERGERLAEEKGRLGDLWV

SEQ ID NO: 3 - protein, 228 aa, Mus sp.
MGAWAMLYGVSMLCVLDLGQPSVVEEPGCGPGKVQNGSGNNTRCCSLYAPGKEDCPKERCICVTPEYHCGDPQCKICKHYPCQPGQRVESQGDIVFGFRCVACAMGTFSAGRDGHCRLWTNCSQFGFLTMFPGNKTHNAVCIPEPLPTEQYGHLTVIFLVMAACIFFLTTVQLGLHIWQLRRQHMCPRETQPFAEVQLSAEDACSFQFPEEERGEQTEEKCHLGGRWP

SEQ ID NO: 4 - protein, 177 aa, Homo sapiens
MCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 5 - protein, 11 aa, Artificial Sequence
  Description of Artificial Sequence: Synthetic peptide
RASQGIRNDLG

SEQ ID NO: 6 - protein, 11 aa, Artificial Sequence
  Description of Artificial Sequence: Synthetic peptide
RASQVIRNDLG

SEQ ID NO: 7 - protein, 14 aa, Artificial Sequence
  Description of Artificial Sequence: Synthetic peptide
TGTSSDVGTYNLVS

SEQ ID NO: 8 - protein, 14 aa, Artificial Sequence
  Description of Artificial Sequence: Synthetic peptide
TGTSSDVGIYNLVS

SEQ ID NO: 9 - protein, 11 aa, Artificial Sequence
  Description of Artificial Sequence: Synthetic peptide
RASQSISSYLH

SEQ ID NO: 10 - protein, 12 aa, Artificial Sequence
  Description of Artificial Sequence: Synthetic peptide
RASQTVSSNYLA

SEQ ID NO: 11 - protein, 7 aa, Artificial Sequence
  Description of Artificial Sequence: Synthetic peptide
DASSLQS

SEQ ID NO: 12 - protein, 7 aa, Artificial Sequence
  Description of Artificial Sequence: Synthetic peptide
AASSLQS

SEQ ID NO: 13 - protein, 7 aa, Artificial Sequence
  Description of Artificial Sequence: Synthetic peptide
AASTLQS

SEQ ID NO: 14 - protein, 7 aa, Artificial Sequence
  Description of Artificial Sequence: Synthetic peptide
ATSSLQS

SEQ ID NO: 15 - protein, 7 aa, Artificial Sequence
  Description of Artificial Sequence: Synthetic peptide
EVSKRPS

SEQ ID NO: 16 - protein, 7 aa, Artificial Sequence
  Description of Artificial Sequence: Synthetic peptide
GASRLQS

SEQ ID NO: 17 - protein, 7 aa, Artificial Sequence
  Description of Artificial Sequence: Synthetic peptide
GSSTRAT

SEQ ID NO: 18 - protein, 9 aa, Artificial Sequence
  Description of Artificial Sequence: Synthetic peptide
LQHNNYPWT

SEQ ID NO: 19 - protein, 9 aa, Artificial Sequence
  Description of Artificial Sequence: Synthetic peptide
LQHHSYPWT

SEQ ID NO: 20 - protein, 9 aa, Artificial Sequence
  Description of Artificial Sequence: Synthetic peptide
LQLNSYPWT

SEQ ID NO: 21 - protein, 9 aa, Artificial Sequence
  Description of Artificial Sequence: Synthetic peptide
LQHNSYPLT

SEQ ID NO: 22 - protein, 10 aa, Artificial Sequence
  Description of Artificial Sequence: Synthetic peptide
CSYAGFSTWV

SEQ ID NO: 23 - protein, 10 aa, Artificial Sequence
  Description of Artificial Sequence: Synthetic peptide
CSYAGYSTWV

SEQ ID NO: 24 - protein, 9 aa, Artificial Sequence
  Description of Artificial Sequence: Synthetic peptide
LQHNSYPWT

SEQ ID NO: 25 - protein, 9 aa, Artificial Sequence
  Description of Artificial Sequence: Synthetic peptide
LQHNSYPIT

SEQ ID NO: 26 - protein, 10 aa, Artificial Sequence
  Description of Artificial Sequence: Synthetic peptide
CSYAGISTWV

SEQ ID NO: 27 - protein, 9 aa, Artificial Sequence
  Description of Artificial Sequence: Synthetic peptide
QQSSSTPLT

SEQ ID NO: 28 - protein, 9 aa, Artificial Sequence
  Description of Artificial Sequence: Synthetic peptide
QQYDSSPWT

SEQ ID NO: 29 - protein, 9 aa, Artificial Sequence
  Description of Artificial Sequence: Synthetic peptide
QQHNSYPWT

SEQ ID NO: 30 - protein, 9 aa, Artificial Sequence
  Description of Artificial Sequence: Synthetic peptide
LQHNTYPWT

SEQ ID NO: 31 - protein, 5 aa, Artificial Sequence
  Description of Artificial Sequence: Synthetic peptide
SYGMH

SEQ ID NO: 32 - protein, 5 aa, Artificial Sequence
  Description of Artificial Sequence: Synthetic peptide
NYGMH

SEQ ID NO: 33 - protein, 5 aa, Artificial Sequence
  Description of Artificial Sequence: Synthetic peptide
SYGMY

SEQ ID NO: 34 - protein, 5 aa, Artificial Sequence
  Description of Artificial Sequence: Synthetic peptide
SCGMH

SEQ ID NO: 35 - protein, 7 aa, Artificial Sequence
  Description of Artificial Sequence: Synthetic peptide
SGGYFWS

SEQ ID NO: 36 - protein, 17 aa, Artificial Sequence
  Description of Artificial Sequence: Synthetic peptide
VIWYEGSNKYYADSVKG

SEQ ID NO: 37 - protein, 17 aa, Artificial Sequence
  Description of Artificial Sequence: Synthetic peptide
VIWYVGSNKYYADSVKG

SEQ ID NO: 38 - protein, 17 aa, Artificial Sequence
  Description of Artificial Sequence: Synthetic peptide
VIWYAGSNKYYADSVKG

SEQ ID NO: 39 - protein, 17 aa, Artificial Sequence
  Description of Artificial Sequence: Synthetic peptide
VIWYEGSNKYYADSVRG

SEQ ID NO: 40 - protein, 17 aa, Artificial Sequence
  Description of Artificial Sequence: Synthetic peptide
VIWYPGSNKYYADSVKG

SEQ ID NO: 41 - protein, 17 aa, Artificial Sequence
  Description of Artificial Sequence: Synthetic peptide
VIWYDGSNKYYADSVKG

SEQ ID NO: 42 - protein, 17 aa, Artificial Sequence
  Description of Artificial Sequence: Synthetic peptide
VIWHDGSNKYYADSVKG

SEQ ID NO: 43 - protein, 17 aa, Artificial Sequence
  Description of Artificial Sequence: Synthetic peptide
VIWSDGNNKYYEDSVKG

SEQ ID NO: 44 - protein, 17 aa, Artificial Sequence
  Description of Artificial Sequence: Synthetic peptide
VISYDGSNKYYADSVKG

SEQ ID NO: 45 - protein, 16 aa, Artificial Sequence
  Description of Artificial Sequence: Synthetic peptide
YIYYSGTTYYNPSLKS

SEQ ID NO: 46 - protein, 14 aa, Artificial Sequence
  Description of Artificial Sequence: Synthetic peptide
GGQLGKYYYYGMDV

SEQ ID NO: 47 - protein, 14 aa, Artificial Sequence
  Description of Artificial Sequence: Synthetic peptide
GGLLGYYYYYGMDV

SEQ ID NO: 48 - protein, 14 aa, Artificial Sequence
  Description of Artificial Sequence: Synthetic peptide
GGELRLYYYYGMDV

SEQ ID NO: 49 - protein, 14 aa, Artificial Sequence
  Description of Artificial Sequence: Synthetic peptide
GGQLGYYYYYGMDV

SEQ ID NO: 50 - protein, 14 aa, Artificial Sequence
  Description of Artificial Sequence: Synthetic peptide
GGELSFYYYYGMDV

SEQ ID NO: 51 - protein, 14 aa, Artificial Sequence
  Description of Artificial Sequence: Synthetic peptide
GGQLGKDYYSGMDV

SEQ ID NO: 52 - protein, 14 aa, Artificial Sequence
  Description of Artificial Sequence: Synthetic peptide
GGELGRYYYYGMDV

SEQ ID NO: 53 - protein, 14 aa, Artificial Sequence
  Description of Artificial Sequence: Synthetic peptide
GGQLGYYYYSGMDV

SEQ ID NO: 54 - protein, 11 aa, Artificial Sequence
  Description of Artificial Sequence: Synthetic peptide
RGTVTTPDFDY

SEQ ID NO: 55 - protein, 8 aa, Artificial Sequence
  Description of Artificial Sequence: Synthetic peptide
EYGGNFDY

SEQ ID NO: 56 - protein, 15 aa, Artificial Sequence
  Description of Artificial Sequence: Synthetic peptide
GDILTGYSLYYGMDV

SEQ ID NO: 57 - protein, 14 aa, Artificial Sequence
  Description of Artificial Sequence: Synthetic peptide
GGQLALYYYYGMDV

SEQ ID NO: 58 - protein, 14 aa, Artificial Sequence
  Description of Artificial Sequence: Synthetic peptide
GGELGRDYYSGMDV

SEQ ID NO: 59 - protein, 14 aa, Artificial Sequence
  Description of Artificial Sequence: Synthetic peptide
GGRLGFYYYYGMDV

SEQ ID NO: 60 - protein, 8 aa, Artificial Sequence
  Description of Artificial Sequence: Synthetic peptide
DTATPFDY

SEQ ID NO: 61 - protein, 13 aa, Artificial Sequence
  Description of Artificial Sequence: Synthetic peptide
DLRYNWNDGGVDY

SEQ ID NO: 62 - protein, 15 aa, Artificial Sequence
  Description of Artificial Sequence: Synthetic peptide
DLFYYDSSGPRGFDP

SEQ ID NO: 63 - protein, 14 aa, Artificial Sequence
  Description of Artificial Sequence: Synthetic peptide
GGRLGKDYYSGMDV

SEQ ID NO: 64 - protein, 14 aa, Artificial Sequence
  Description of Artificial Sequence: Synthetic peptide
TGTSSDVGTYNLVS

SEQ ID NO: 65 - protein, 10 aa, Artificial Sequence
  Description of Artificial Sequence: Synthetic peptide
ASYAGFSTWV

SEQ ID NO: 66 - protein, 10 aa, Artificial Sequence
  Description of Artificial Sequence: Synthetic peptide
ASYAGYSTWV

SEQ ID NO: 67 - protein, 9 aa, Artificial Sequence
  Description of Artificial Sequence: Synthetic peptide
QQYESSPWT

SEQ ID NO: 68 - protein, 9 aa, Artificial Sequence
  Description of Artificial Sequence: Synthetic peptide
QQYDTSPWT

SEQ ID NO: 69 - protein, 17 aa, Artificial Sequence
  Description of Artificial Sequence: Synthetic peptide
VIWYVGSNKYYAESVKG

SEQ ID NO: 70 - protein, 17 aa, Artificial Sequence
  Description of Artificial Sequence: Synthetic peptide
VIWYVGSNKYYADTVKG

SEQ ID NO: 71 - protein, 17 aa, Artificial Sequence
  Description of Artificial Sequence: Synthetic peptide
VIWYEGSNKYYAESVKG

SEQ ID NO: 72 - protein, 17 aa, Artificial Sequence
  Description of Artificial Sequence: Synthetic peptide
VIWYEGSNKYYADTVKG

SEQ ID NO: 73 - protein, 17 aa, Artificial Sequence
  Description of Artificial Sequence: Synthetic peptide
VIWYPGSNKYYAESVKG

SEQ ID NO: 74 - protein, 17 aa, Artificial Sequence
  Description of Artificial Sequence: Synthetic peptide
VIWYPGSNKYYADTVKG

SEQ ID NO: 75 - protein, 15 aa, Artificial Sequence
  Description of Artificial Sequence: Synthetic peptide
DLFYYESSGPRGFDP

SEQ ID NO: 76 - protein, 15 aa, Artificial Sequence
  Description of Artificial Sequence: Synthetic peptide
DLFYYDTSGPRGFDP

SEQ ID NO: 77 - protein, 15 aa, Artificial Sequence
  Description of Artificial Sequence: Synthetic peptide
DLFYYDSSGPRGFEP

SEQ ID NO: 78 - protein, 15 aa, Artificial Sequence
  Description of Artificial Sequence: Synthetic peptide
DLFYYESSGPRGFEP

SEQ ID NO: 79 - protein, 15 aa, Artificial Sequence
  Description of Artificial Sequence: Synthetic peptide
DLFYYDTSGPRGFEP

SEQ ID NO: 80 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgatgcatccagtttgcaaagtggggtcccatcaaggttcagcggcagtggatctgggacagaattcactctcacaatcagcagcctgcagcctgaagattttgcaacttattactgtctacagcataataattatccgtggacgttcggccaagggaccaaggtggaaatcaaacgt

SEQ ID NO: 81 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaggcccctaagcgcctgatttatgatgcatccagtttgcaaagtggggtcccatcaaggttcagcggcagtggatctgggacagaattcactctcacaatcagcagcctgcagcctgaagattttgcaacttattactgtctacagcatcatagttacccgtggacgttcggccaagggaccaaggtggaaatcaaacga

SEQ ID NO: 82 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacagtcagcagcctgcagcctgaagattttgcaacttattactgtctacagcttaatagttacccttggacgttcggccaagggaccaaggtggaaatcaaacga

SEQ ID NO: 83 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatttatgatgcgtccagtttacaaagtggggtcccatcaaggttcagcggcagtggatctgggacagatttcactctcacaatcagcagcctgcagcctgaagattttgcaacttattactgtctacagcttaatagttacccgtggacgttcggccaagggaccaaggtggaaatcaaacga

SEQ ID NO: 84 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccactttgcaaagtggggtcccatcaaggttcagcggcagtggatctgggacagaattcactctcacaatcagcagcctgcagcctgaagattttgcaacttattactgtctacagcataataattacccgtggacgttcggccaagggaccaaggtggaaatcaaacga

SEQ ID NO: 85 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggtcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaacga

SEQ ID NO: 86 - DNA, 324 bp, Artificial Sequence
  Description of Artificial Sequence: Synthetic polynucleotide
gacatccagatgacccagtctccatcctccctgtctgcatctgtaggagacagagtcaccgtcacttgccgggcaagtcagggcattagaaatgatttaggctggtatcagcagaaaccagggaaagcccctaagcgcctgatttatgctgcgtccagtttgcaaagtggggtcccatcaaggttcagcggcagtggatctgggacagagttcactctcacaatcagcagcctgcagcctgaagattttgcaacttattactgtctacagcataataattacccgtggacgttcggccaagggaccaaggtggacatcaaacga

SEQ ID NO: 87 - DNA, 324 bp, Artificial Sequence
  Description of Artificial Sequence: Synthetic polynucleotide
gacatccagatgacccagtctccatcctccctgtctgcatctgttggagacagagtcaccatcacttgccgggcaagtcagggcattagaaatgatttaggctggtatcagcagaaaccagggaaagcccctaagcgcctgatttatgatgcgtccagtttgcaaagtggggtcccatcaaggttcagcggcagtggatctgggacagatttcactctcacaatcagcagcctgcagcctgaagagtttgcaacttattactgtctacagcataataattacccgtggacgttcggccaagggaccaaggtggaaatcaaacga

SEQ ID NO: 88 - DNA, 333 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggacttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgactattactgctgctcatatgcaggttttagcacttgggtgttcggcggagggaccaagctgaccgtcctaggt

SEQ ID NO: 89 - DNA, 333 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggacttataaccttgtctcctggtaccaacagcacccaggcaaagcccccaaactcatgatttatgaggtcagtaagcggccctcaggaatttctaatcgcttctctggctccaagtctggcaacacggcctccctgacaatctctgggctccaggctgaggacgaggctgattattactgctgctcatatgcaggttatagcacttgggtgttcggcggagggaccaaattgaccgtcctacgt

SEQ ID NO: 90 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctggggcagaattcactctcacaatcagcagcctgcagcctgaagattttgcaacttattactgtctacagcataatagttacccgtggacgttcggccaagggaccaaggtggaaatcaaacga

SEQ ID NO: 91 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataataattacccgtggacgttcggccaagggaccaaggtggaaatcaaacga

SEQ ID NO: 92 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagccaggtcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgatcactttcggcggagggaccaaggtggagatcaaacga

SEQ ID NO: 93 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcttaatagttacccgtggacgttcggccaagggaccaaggtggaaatcaaacga

SEQ ID NO: 94 - DNA, 333 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggatttataaccttgtctcctggtaccaacagcacccaggcaaagcccccaaactcatgattcacgaggtcagtaagcggccctcaggggtttctaatcgcttctctggctccaagtctggcaacacggcctccctgacaatctctgggctccaggctgaggacgaggctgattattactgctgctcatatgcaggtattagtacttgggtattcggcggagggaccaagctgaccgtcctaggt

SEQ ID NO: 95 - DNA, 324 bp, Artificial Sequence
  Description of Artificial Sequence: Synthetic polynucleotide
gacatccagatgacccagtctccatcctccctgtctgcatctgtaggagacagagtcatcatcacttgccgggcaagtcagagcattagcagttatttacattggtataagcagaaaccagggaaagcccctaagctcctgatctacggtgcatccagattgcaaagtggggtcccatcaaggttcagtggcagtggatctgggacagatttcactctcaccatcagcagtctgcaacctgaagattttgcaacttactactgtcaacagagttccagtacccccctcactttcggcggagggaccaaggtggagatcaagcga

SEQ ID NO: 96 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagactgtttccagcaactacttagcctggtaccagcagaaacctggccaggctcccaggctcctcatctatggttcatccaccagggccactggcatcccagacaggttcagtggcagtgggtctgggacagacttcactctaaccatcagcagactggagcctgaagattttgcagtgtattactgtcagcagtatgatagctcaccgtggacgttcggccaagggaccaaggtggaaatcaaacgt

SEQ ID NO: 97 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgactgatctatgctgcatccagtctgcaaagtggggtcccatcaaggttcagcggcagtggatctgggacagaattcactctcacaatcagcagcctgcagcctgaagattttgcaacttattactgtcaacagcataatagttacccgtggacgttcggccaagggaccaaggtggaaatcaaacgt

SEQ ID NO: 98 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaaccgcctgatctatgctacatccagtttgcaaagtggggtcccatcaaggttcagcggcagtggatctgggacagaattcactctcacaatcagcagcctgcagcctgaagattttgcaacttattactgtctacagcataatacttacccgtggacgttcggccaagggaccaaggtggaaatcaaacgt

SEQ ID NO: 99 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcacgttcagtagctatggcatgcactgggtccgccaggctccaggcaaggggctggagtgggtgacagttatatggtatgaaggaagtaacaaatactatgcagactccgtgaagggccgattcaccatctccagagacaattccaagaacacgctgtatctgcaaatgaacagcctgagagccgaggacacggctgtgtattactgtgcgagaggggggcagctcgggaagtattattattacggtatggacgtctggggccaagggaccacggtcaccgtctcctca

SEQ ID NO: 100 - DNA, 369 bp, Artificial Sequence
  Description of Artificial Sequence: Synthetic polynucleotide
caggtgcaggtggtggagtctgggggaggcgtggtccagcctgggaggtccctgagactctcctgtgcagcgtctggattcaccttcagtagctatggcatgcactgggtccgccaggctccaggcaaggggctggagtgggtgtcagttatatggtatgaaggaagtaataaatactatgcagactccgtgaagggccgattcaccatctccagagacaattccaagaacacgctgtatctgcaaatgaacagcctgagagccgaggacacggctgtgtattactgtgcgagaggaggtcttttgggttactactactactacggtatggacgtctggggccaagggaccacggtcaccgtctcctca

SEQ ID NO: 101 - DNA, 369 bp, Artificial Sequence
  Description of Artificial Sequence: Synthetic polynucleotide
caggtgcagctggtggagtctgggggaggcgtggtccagcctgggaggtccctgaggctctcctgtgcagcgtctggattcaccttcagtaactatggcatgcactgggtccgccaggctccaggcaaggggctggagtgggtggcagttatatggtatgttggaagtaataaatactatgcagactccgtgaagggccgattcaccatctccagagacaattccaagaacacgctgtatctgcaaatgaacagcctgagagccgaggacacggctgtgtattactgtgcgagaggaggggaactacgcctctactactactacggtatggacgtctggggccaagggaccacggtcaccgtctcctca

SEQ ID NO: 102 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatactatgcagactccgtgaagggccgattcaccatctccagagacaattccaagaacacgctgtatctgcaaatgaacagcctgagagccgaggacacggctgtgtattactgtgcgagaggggggcagctcgggtactactactactacggtatggacgtctggggccaagggaccacggtcaccgtctcctca

SEQ ID NO: 103 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgctggaagtaataaatactatgcagactccgtgaagggccgattcaccatctccagagacaattccaagaacacgctgtatctgcaaatgaacagcctgagagccgaggacacggctgtgtattactgtgcgagagggggggaactgtccttctactactattacggtatggacgtctggggccaagggaccacggtcaccgtctcctca

SEQ ID NO: 104 - DNA, 369 bp, Artificial Sequence
  Description of Artificial Sequence: Synthetic polynucleotide
caggtgcaggtggtggagtctgggggaggcgtggtccagcctgggaggtccctgagactctcctgtgcagcgtctggattcaccttcagtagctatggcatgtactgggtccgccaggctccaggcaaggggctggagtgggtggcagttatatggtatgaaggaagtaataaatactatgcagactccgtgaggggccgattcaccatctccagagacaattccaagaacacgctgtatctgcaaatgaacagcctgagagccgaggacacggctctgtattactgtgcgagaggcggccaactggggaaggactactactccggtatggacgtctggggccaagggaccacggtcaccgtctcctca

SEQ ID NO: 105 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatcctggaagtaataaatactatgcagactccgtgaagggccgattcaccatctccagagacaattccaagaacacgctgtatctgcaaatgaacagcctgagagccgaggacacggctgtgtattactgtgcgagagggggggaactggggaggtactactactacggtatggacgtctggggccaagggaccacggtcaccgtctcctca

SEQ ID NO: 106 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatactatgcagactccgtgaagggccgattcaccatctccagagacaattccaagaatacgctgtatctgcaaatgaacagcctgagagccgaggacacggctgtgtattactgtgcgagaggggggcagctcgggtactactactactccggtatggacgtctggggccaagggaccacggtcaccgtctcctca

SEQ ID NO: 107 - DNA, 360 bp, Artificial Sequence
  Description of Artificial Sequence: Synthetic polynucleotide
caggtgcaactggtggagtctgggggaggcgtggtccagcctgggaggtccctgagactctcctgtgcggcgtctggattcaccttaagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggggtacagtaaccacccccgactttgactactggggccagggaaccctggtcaccgtctcctca

SEQ ID NO: 108 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatttggcatgatggaagtaataaatactatgcagactccgtgaagggccgattcaccatctccaaagacaattccaagaacacgctgtatctgcaaatgaacagcctgagagccgaggacacggctgtgtattactgtgcgagagagtacggtggtaattttgactactggggccagggaaccctggtcaccgtctcctca

SEQ ID NO: 109 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcagttatatggtatgctggaagtaataaatattatgcagactccgtgaagggccgattcaccatctccagagacaattccaagaacacgctgtatctgcaaatgaacagcctgagagccgaggacacggctgtgtattactgtgcgagaggcgatattttgactggttattccctctactacggtatggacgtctggggccaagggaccacggtcaccgtctcctca

SEQ ID NO: 110 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgctggaagtaataaatactatgcagactccgtgaagggccgattcaccatctccagagacaattccaagaacacggtgtatctgcaaatgaacagcctgagagccgaggacacggctgtgtattactgtgcgagaggggggcagctcgccctctactactactacggtatggacgtctggggccaagggaccacggtcaccgtctcctca

SEQ ID NO: 111 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgtactgggtccgccaggctccaggcaaggggctggagtgggtggcagttatatggtatgaaggaagtaataaatactatgcagactccgtgaagggccgattcaccatctccagagacaattccaagaacacgctgtatctgcaaatgaacagcctgagagccgaggacacggctgtgtatttctgtgcgagagggggggaactggggagggactactactccggtatggacgtctggggccaagggaccacggtcaccgtctcctca

SEQ ID NO: 112 - DNA, 369 bp, Artificial Sequence
  Description of Artificial Sequence: Synthetic polynucleotide
cagatgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgctggaagtaataaatactatgcagactccgtgaagggccgattcaccatctccagagacaattccaagaacacgctgtatctgcaaatgaacagcctgagagccgaggacacggctgtgtattactgtgcgagaggggggaggttgggtttttactactactacggtatggacgtctggggccaagggaccacggtcaccgtctcctca

SEQ ID NO: 113 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtctgatggaaataataaatattatgaagactccgtgaagggccgattcaccatctccagagacagttccaagaacacgctgtttctgcaaatgaacagcctgagagccgaggacacggctgtgtattactgtgcgagagatacagctaccccttttgactactggggccagggaaccctggtcaccgtctcctca

SEQ ID NO: 114 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctgtggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagatctacggtacaactggaacgacgggggagttgactactggggccagggaaccctggtcaccgtctcctca

SEQ ID NO: 115 - DNA, 375 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttacttctggagctggatccgccagcacccagggaagggcctggagtggattgggtacatctattacagtgggaccacctactataacccgtccctcaagagtcgagttaccatatcaatagacacgtctaagaaccatttctccctgaagctgagctctgtgactgccgcggacacggccgtatattactgtgcgagagatcttttttactatgatagtagtggtcctagggggttcgacccctggggccagggaaccctggtcaccgtctcctca

SEQ ID NO: 116 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtggatggcagttatatggtatgttggaagtaataaatactatgcagactccgtgaagggccgattcaccatctccagagacaattccaagaacacgctgtatctgcaaatgaacagcctgagcgccgaggacacggctgtgtattactgtgcgagaggtggagaactggggagagactactactccggtatggacgtctggggccaagggaccacggtcaccgtctcctca

SEQ ID NO: 117 - DNA, 369 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagttatggcatgcactggatccgccaggctccaggcaaggggctggagtgggtggcagttatatggtatgaaggaagtaataaatattatgcagactccgtgaagggccgattcaccatctccagagacaattccaagaacacgctgtatctgcaaatgaacagcctgagagccgaggacacggctgtgtattactgtgcgagagggggtagactggggaaggactactactccggtatggacgtctggggccaagggaccacggtcaccgtctcctca

SEQ ID NO: 118 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYDASSLQSGVPSRFSGSGSGTEFTLTISSLQPEDFATYYCLQHNNYPWTFGQGTKVEIKR

SEQ ID NO: 119 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYDASSLQSGVPSRFSGSGSGTEFTLTISSLQPEDFATYYCLQHHSYPWTFGQGTKVEIKR

SEQ ID NO: 120 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTVSSLQPEDFATYYCLQLNSYPWTFGQGTKVEIKR

SEQ ID NO: 121 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYDASSLQSGVPSRFSGSGSGTDFTLTISSLQPEDFATYYCLQLNSYPWTFGQGTKVEIKR

SEQ ID NO: 122 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASTLQSGVPSRFSGSGSGTEFTLTISSLQPEDFATYYCLQHNNYPWTFGQGTKVEIKR

SEQ ID NO: 123 - protein, 108 aa, Artificial Sequence
  Description of Artificial Sequence: Synthetic polypeptide
DIQMTQSPSSLSASVGDRVTITCRASQVIRNDLGWYQQKPGKAPKRLIYAASSLQSGVPSRFSGSGSGTEFTLTISSLQPEDFATYYCLQHNSYPLTFGGGTKVEIKR

SEQ ID NO: 124 - protein, 108 aa, Artificial Sequence
  Description of Artificial Sequence: Synthetic polypeptide
DIQMTQSPSSLSASVGDRVTVTCRASQGIRNDLGWYQQKPGKAPKRLIYAASSLQSGVPSRFSGSGSGTEFTLTISSLQPEDFATYYCLQHNNYPWTFGQGTKVDIKR

SEQ ID NO: 125 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYDASSLQSGVPSRFSGSGSGTDFTLTISSLQPEEFATYYCLQHNNYPWTFGQGTKVEIKR

SEQ ID NO: 126 - protein, 111 aa, Artificial Sequence
  Description of Artificial Sequence: Synthetic polypeptide
QSALTQPASVSGSPGQSITISCTGTSSDVGTYNLVSWYQQHPGKAPKLMIYEVSKRPSGVSNRFSGSKSGNTASLTISGLQAEDEADYYCCSYAGFSTWVFGGGTKLTVLG

SEQ ID NO: 127 - protein, 111 aa, Artificial Sequence
  Description of Artificial Sequence: Synthetic polypeptide
QSALTQPASVSGSPGQSITISCTGTSSDVGTYNLVSWYQQHPGKAPKLMIYEVSKRPSGISNRFSGSKSGNTASLTISGLQAEDEADYYCCSYAGYSTWVFGGGTKLTVLR

SEQ ID NO: 128 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGAEFTLTISSLQPEDFATYYCLQHNSYPWTFGQGTKVEIKR

SEQ ID NO: 129 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNNYPWTFGQGTKVEIKR

SEQ ID NO: 130 - protein, 108 aa, Artificial Sequence
  Description of Artificial Sequence: Synthetic polypeptide
DIQMTQSPSSLSASVGDRVTITCRASQVIRNDLGWYQQKPGKAPKRLIYAASSLQSGVPSRFSGSGSGTEFTLTISSLQPEDFATYYCLQHNSYPITFGGGTKVEIKR

SEQ ID NO: 131 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLNSYPWTFGQGTKVEIKR

SEQ ID NO: 132 - protein, 111 aa, Artificial Sequence
  Description of Artificial Sequence: Synthetic polypeptide
QSALTQPASVSGSPGQSITISCTGTSSDVGIYNLVSWYQQHPGKAPKLMIHEVSKRPSGVSNRFSGSKSGNTASLTISGLQAEDEADYYCCSYAGISTWVFGGGTKLTVLG

SEQ ID NO: 133 - protein, 108 aa, Artificial Sequence
  Description of Artificial Sequence: Synthetic polypeptide
DIQMTQSPSSLSASVGDRVIITCRASQSISSYLHWYKQKPGKAPKLLIYGASRLQSGVPSRFSGSGSGTDFTLTISSLQPEDFATYYCQQSSSTPLTFGGGTKVEIKR

SEQ ID NO: 134 - protein, 109 aa, Artificial Sequence
  Description of Artificial Sequence: Synthetic polypeptide
EIVLTQSPGTLSLSPGERATLSCRASQTVSSNYLAWYQQKPGQAPRLLIYGSSTRATGIPDRFSGSGSGTDFTLTISRLEPEDFAVYYCQQYDSSPWTFGQGTKVEIKR

SEQ ID NO: 135 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCQQHNSYPWTFGQGTKVEIKR

SEQ ID NO: 136 - protein, 108 aa, Artificial Sequence
  Description of Artificial Sequence: Synthetic polypeptide
DIQMTQSPSSLSASVGDRVTITCRASQGIRNDLGWYQQKPGKAPNRLIYATSSLQSGVPSRFSGSGSGTEFTLTISSLQPEDFATYYCLQHNTYPWTFGQGTKVEIKR

SEQ ID NO: 137 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVTVIWYEGSNKYYADSVKGRFTISRDNSKNTLYLQMNSLRAEDTAVYYCARGGQLGKYYYYGMDVWGQGTTVTVSS

SEQ ID NO: 138 - protein, 123 aa, Artificial Sequence
  Description of Artificial Sequence: Synthetic polypeptide
QVQVVESGGGVVQPGRSLRLSCAASGFTFSSYGMHWVRQAPGKGLEWVSVIWYEGSNKYYADSVKGRFTISRDNSKNTLYLQMNSLRAEDTAVYYCARGGLLGYYYYYGMDVWGQGTTVTVSS

SEQ ID NO: 139 - protein, 123 aa, Artificial Sequence
  Description of Artificial Sequence: Synthetic polypeptide
QVQLVESGGGVVQPGRSLRLSCAASGFTFSNYGMHWVRQAPGKGLEWVAVIWYVGSNKYYADSVKGRFTISRDNSKNTLYLQMNSLRAEDTAVYYCARGGELRLYYYYGMDVWGQGTTVTVSS

SEQ ID NO: 140 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGQLGYYYYYGMDVWGQGTTVTVSS

SEQ ID NO: 141 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGELSFYYYYGMDVWGQGTTVTVSS

SEQ ID NO: 142 - protein, 123 aa, Artificial Sequence
  Description of Artificial Sequence: Synthetic polypeptide
QVQVVESGGGVVQPGRSLRLSCAASGFTFSSYGMYWVRQAPGKGLEWVAVIWYEGSNKYYADSVRGRFTISRDNSKNTLYLQMNSLRAEDTALYYCARGGQLGKDYYSGMDVWGQGTTVTVSS

SEQ ID NO: 143 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYPGSNKYYADSVKGRFTISRDNSKNTLYLQMNSLRAEDTAVYYCARGGELGRYYYYGMDVWGQGTTVTVSS

SEQ ID NO: 144 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGQLGYYYYSGMDVWGQGTTVTVSS

SEQ ID NO: 145 - protein, 120 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRFTISRDNSKNTLYLQMNSLRAEDTAVYYCARRGTVTTPDFDYWGQGTLVTVSS

SEQ ID NO: 146 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWHDGSNKYYADSVKGRFTISKDNSKNTLYLQMNSLRAEDTAVYYCAREYGGNFDYWGQGTLVTVSS

SEQ ID NO: 147 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGDILTGYSLYYGMDVWGQGTTVTVSS

SEQ ID NO: 148 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYAGSNKYYADSVKGRFTISRDNSKNTVYLQMNSLRAEDTAVYYCARGGQLALYYYYGMDVWGQGTTVTVSS

SEQ ID NO: 149 - protein, 123 aa, Artificial Sequence
  Description of Artificial Sequence: Synthetic polypeptide
QVQLVESGGGVVQPGRSLRLSCAASGFTFSSYGMYWVRQAPGKGLEWVAVIWYEGSNKYYADSVKGRFTISRDNSKNTLYLQMNSLRAEDTAVYFCARGGELGRDYYSGMDVWGQGTTVTVSS

SEQ ID NO: 150 - protein, 123 aa, Artificial Sequence
  Description of Artificial Sequence: Synthetic polypeptide
QMQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRLGFYYYYGMDVWGQGTTVTVSS

SEQ ID NO: 151 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWSDGNNKYYEDSVKGRFTISRDSSKNTLFLQMNSLRAEDTAVYYCARDTATPFDYWGQGTLVTVSS

SEQ ID NO: 152 - protein, 122 aa, Artificial Sequence
  Description of Artificial Sequence: Synthetic polypeptide
QVQLVESGGGVVQPGRSLRLSCAASGFTFSSCGMHWVRQAPGKGLEWVAVISYDGSNKYYADSVKGRFTISRDNSKNTLYLQMNSLRAEDTAVYYCARDLRYNWNDGGVDYWGQGTLVTVSS

SEQ ID NO: 153 - protein, 125 aa, Artificial Sequence
  Description of Artificial Sequence: Synthetic polypeptide
QVQLQESGPGLVKPSQTLSLTCTVSGGSISSGGYFWSWIRQHPGKGLEWIGYIYYSGTTYYNPSLKSRVTISIDTSKNHFSLKLSSVTAADTAVYYCARDLFYYDSSGPRGFDPWGQGTLVTVSS

SEQ ID NO: 154 - protein, 123 aa, Artificial Sequence
  Description of Artificial Sequence: Synthetic polypeptide
QVQLVESGGGVVQPGRSLRLSCAASGFTFSSYGMHWVRQAPGKGLEWMAVIWYVGSNKYYADSVKGRFTISRDNSKNTLYLQMNSLSAEDTAVYYCARGGELGRDYYSGMDVWGQGTTVTVSS

SEQ ID NO: 155 - protein, 123 aa, Artificial Sequence
  Description of Artificial Sequence: Synthetic polypeptide
QVQLVESGGGVVQPGRSLRLSCVASGFTFSSYGMHWIRQAPGKGLEWVAVIWYEGSNKYYADSVKGRFTISRDNSKNTLYLQMNSLRAEDTAVYYCARGGRLGKDYYSGMDVWGQGTTVTVSS

SEQ ID NO: 156 - DNA, 333 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggacttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgactattactgcgcttcatatgcaggttttagcacttgggtgttcggcggagggaccaagctgaccgtcctaggt

SEQ ID NO: 157 - DNA, 333 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggacttataaccttgtctcctggtaccaacagcacccaggcaaagcccccaaactcatgatttatgaggtcagtaagcggccctcaggaatttctaatcgcttctctggctccaagtctggcaacacggcctccctgacaatctctgggctccaggctgaggacgaggctgattattactgcgcttcatatgcaggttatagcacttgggtgttcggcggagggaccaaattgaccgtcctacgt

SEQ ID NO: 158 - DNA, 324 bp, Artificial Sequence; identical to SEQ ID NO: 93
  Description of Artificial Sequence: Synthetic polynucleotide

SEQ ID NO: 159 - DNA, 333 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggatttataaccttgtctcctggtaccaacagcacccaggcaaagcccccaaactcatgattcacgaggtcagtaagcggccctcaggggtttctaatcgcttctctggctccaagtctggcaacacggcctccctgacaatctctgggctccaggctgaggacgaggctgattattactgcgcttcatatgcaggtattagtacttgggtattcggcggagggaccaagctgaccgtcctaggt

SEQ ID NO: 160 - DNA, 324 bp, Artificial Sequence; identical to SEQ ID NO: 95
  Description of Artificial Sequence: Synthetic polynucleotide

SEQ ID NO: 161 - DNA, 327 bp, Artificial Sequence; identical to SEQ ID NO: 96
  Description of Artificial Sequence: Synthetic polynucleotide

SEQ ID NO: 162 - DNA, 327 bp, Artificial Sequence; identical to SEQ ID NO: 96
  Description of Artificial Sequence: Synthetic polynucleotide

SEQ ID NO: 163 - DNA, 327 bp, Artificial Sequence; identical to SEQ ID NO: 96
  Description of Artificial Sequence: Synthetic polynucleotide

SEQ ID NO: 164 - DNA, 327 bp, Artificial Sequence; identical to SEQ ID NO: 96
  Description of Artificial Sequence: Synthetic polynucleotide

SEQ ID NO: 165 - DNA, 327 bp, Artificial Sequence; identical to SEQ ID NO: 96
  Description of Artificial Sequence: Synthetic polynucleotide

SEQ ID NO: 166 - DNA, 327 bp, Artificial Sequence; identical to SEQ ID NO: 96
  Description of Artificial Sequence: Synthetic polynucleotide

SEQ ID NO: 167 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagactgtttccagcaactacttagcctggtaccagcagaaacctggccaggctcccaggctcctcatctatggttcatccaccagggccactggcatcccagacaggttcagtggcagtgggtctgggacagacttcactctaaccatcagcagactggagcctgaagattttgcagtgtattactgtcagcagtatgagagctcaccgtggacgttcggccaagggaccaaggtggaaatcaaacgt

SEQ ID NO: 168 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagactgtttccagcaactacttagcctggtaccagcagaaacctggccaggctcccaggctcctcatctatggttcatccaccagggccactggcatcccagacaggttcagtggcagtgggtctgggacagacttcactctaaccatcagcagactggagcctgaagattttgcagtgtattactgtcagcagtatgatacctcaccgtggacgttcggccaagggaccaaggtggaaatcaaacgt

SEQ ID NO: 169 - DNA, 327 bp, Artificial Sequence; identical to SEQ ID NO: 167
  Description of Artificial Sequence: Synthetic polynucleotide

SEQ ID NO: 170 - DNA, 327 bp, Artificial Sequence; identical to SEQ ID NO: 167
  Description of Artificial Sequence: Synthetic polynucleotide

SEQ ID NO: 171 - DNA, 327 bp, Artificial Sequence; identical to SEQ ID NO: 168
  Description of Artificial Sequence: Synthetic polynucleotide

SEQ ID NO: 172 - DNA, 327 bp, Artificial Sequence; identical to SEQ ID NO: 168
  Description of Artificial Sequence: Synthetic polynucleotide

SEQ ID NO: 173 - DNA, 327 bp, Artificial Sequence; identical to SEQ ID NO: 168
  Description of Artificial Sequence: Synthetic polynucleotide

SEQ ID NO: 174 - DNA, 327 bp, Artificial Sequence; identical to SEQ ID NO: 167
  Description of Artificial Sequence: Synthetic polynucleotide

SEQ ID NO: 175 - DNA, 324 bp, Artificial Sequence; identical to SEQ ID NO: 97
  Description of Artificial Sequence: Synthetic polynucleotide

SEQ ID NO: 176 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagctgctgatctatgctgcatccagtctgcaaagtggggtcccatcaaggttcagcggcagtggatctgggacagaattcactctcacaatcagcagcctgcagcctgaagattttgcaacttattactgtcaacagcataatagttacccgtggacgttcggccaagggaccaaggtggaaatcaaacgt

SEQ ID NO: 177 - DNA, 324 bp, Artificial Sequence; identical to SEQ ID NO: 97
  Description of Artificial Sequence: Synthetic polynucleotide

SEQ ID NO: 178 - DNA, 324 bp, Artificial Sequence; identical to SEQ ID NO: 97
  Description of Artificial Sequence: Synthetic polynucleotide

SEQ ID NO: 179 - DNA, 324 bp, Artificial Sequence; identical to SEQ ID NO: 176
  Description of Artificial Sequence: Synthetic polynucleotide

SEQ ID NO: 180 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctacatccagtttgcaaagtggggtcccatcaaggttcagcggcagtggatctgggacagaattcactctcacaatcagcagcctgcagcctgaagattttgcaacttattactgtctacagcataatacttacccgtggacgttcggccaagggaccaaggtggaaatcaaacgt

SEQ ID NO: 181 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctacatccagtttgcaaagtggggtcccatcaaggttcagcggcagtggatctgggacagaattcactctcacaatcagcagcctgcagcctgaagattttgcaacttattactgtctacagcataatacttacccgtggacgttcggccaagggaccaaggtggaaatcaaacgt

SEQ ID NO: 182 - DNA, 324 bp, Artificial Sequence; identical to SEQ ID NO: 180
  Description of Artificial Sequence: Synthetic polynucleotide

SEQ ID NO: 183 - DNA, 324 bp, Artificial Sequence; identical to SEQ ID NO: 180
  Description of Artificial Sequence: Synthetic polynucleotide

SEQ ID NO: 184 - DNA, 324 bp, Artificial Sequence; identical to SEQ ID NO: 181
  Description of Artificial Sequence: Synthetic polynucleotide

SEQ ID NO: 185 - DNA, 324 bp, Artificial Sequence; identical to SEQ ID NO: 181
  Description of Artificial Sequence: Synthetic polynucleotide

SEQ ID NO: 186 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaggcccctaagctcctgatttatgatgcatccagtttgcaaagtggggtcccatcaaggttcagcggcagtggatctgggacagaattcactctcacaatcagcagcctgcagcctgaagattttgcaacttattactgtctacagcatcatagttacccgtggacgttcggccaagggaccaaggtggaaatcaaacga

SEQ ID NO: 187 - DNA, 324 bp, Artificial Sequence; identical to SEQ ID NO: 81
  Description of Artificial Sequence: Synthetic polynucleotide

SEQ ID NO: 188 - DNA, 324 bp, Artificial Sequence; identical to SEQ ID NO: 81
  Description of Artificial Sequence: Synthetic polynucleotide

SEQ ID NO: 189 - DNA, 324 bp, Artificial Sequence; identical to SEQ ID NO: 186
  Description of Artificial Sequence: Synthetic polynucleotide

SEQ ID NO: 190 - DNA, 324 bp, Artificial Sequence; identical to SEQ ID NO: 186
  Description of Artificial Sequence: Synthetic polynucleotide

SEQ ID NO: 191 - DNA, 324 bp, Artificial Sequence
  Description of Artificial Sequence: Synthetic polynucleotide
gacatccagatgacccagtctccatcctccctgtctgcatctgtaggagacagagtcaccgtcacttgccgggcaagtcagggcattagaaatgatttaggctggtatcagcagaaaccagggaaagcccctaagctcctgatttatgctgcgtccagtttgcaaagtggggtcccatcaaggttcagcggcagtggatctgggacagagttcactctcacaatcagcagcctgcagcctgaagattttgcaacttattactgtctacagcataataattacccgtggacgttcggccaagggaccaaggtggacatcaaacga

SEQ ID NO: 192 - DNA, 324 bp, Artificial Sequence; identical to SEQ ID NO: 86
  Description of Artificial Sequence: Synthetic polynucleotide

SEQ ID NO: 193 - DNA, 324 bp, Artificial Sequence; identical to SEQ ID NO: 86
  Description of Artificial Sequence: Synthetic polynucleotide

SEQ ID NO: 194 - DNA, 324 bp, Artificial Sequence; identical to SEQ ID NO: 191
  Description of Artificial Sequence: Synthetic polynucleotide

SEQ ID NO: 195 - DNA, 324 bp, Artificial Sequence; identical to SEQ ID NO: 191
  Description of Artificial Sequence: Synthetic polynucleotide

SEQ ID NO: 196 - DNA, 360 bp, Artificial Sequence; identical to SEQ ID NO: 107
  Description of Artificial Sequence: Synthetic polynucleotide

SEQ ID NO: 197 - DNA, 351 bp, Artificial Sequence; identical to SEQ ID NO: 108
  Description of Artificial Sequence: Synthetic polynucleotide

SEQ ID NO: 198 - DNA, 369 bp, Artificial Sequence
  Description of Artificial Sequence: Synthetic polynucleotide
cagatgcagctggtggagtctgggggaggcgtggtccagcctgggggatccctgagactctcctgtgcagcgtctggattcaccttcagtagctatggcatgcactgggtccgccaggctccaggcaaggggctggagtgggtggcagttatatggtatgctggaagtaataaatactatgcagactccgtgaagggccgattcaccatctccagagacaattccaagaacacgctgtatctgcaaatgaacagcctgagagccgaggacacggctgtgtattactgtgcgagaggggggaggttgggtttttactactactacggtatggacgtctggggccaagggaccacggtcaccgtctcctca

SEQ ID NO: 199 - DNA, 351 bp, Artificial Sequence; identical to SEQ ID NO: 113
  Description of Artificial Sequence: Synthetic polynucleotide

SEQ ID NO: 200 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctacggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagatctacggtacaactggaacgacgggggagttgactactggggccagggaaccctggtcaccgtctcctca

SEQ ID NO: 201 - DNA, 375 bp, Artificial Sequence
  Description of Artificial Sequence: Synthetic polynucleotide
caggtgcagctgcaggagtcgggcccaggactggtgaagccttcagagaccctgtccctcacctgcactgtctctggtggctccatcagcagtggtggttacttctggagctggatccgccagcccccagggaagggcctggagtggattgggtacatctattacagtgggaccacctactataacccgtccctcaagagtcgagttaccatatcaatagacacgtctaagaaccagttctccctgaagctgagctctgtgactgccgcggacacggccgtatattactgtgcgagagatcttttttactatgagagtagtggtcctagggggttcgacccctggggccagggaaccctggtcaccgtctcctca

SEQ ID NO: 202 - DNA, 375 bp, Artificial Sequence
  Description of Artificial Sequence: Synthetic polynucleotide
caggtgcagctgcaggagtcgggcccaggactggtgaagccttcagagaccctgtccctcacctgcactgtctctggtggctccatcagcagtggtggttacttctggagctggatccgccagcccccagggaagggcctggagtggattgggtacatctattacagtgggaccacctactataacccgtccctcaagagtcgagttaccatatcaatagacacgtctaagaaccagttctccctgaagctgagctctgtgactgccgcggacacggccgtatattactgtgcgagagatcttttttactatgataccagtggtcctagggggttcgacccctggggccagggaaccctggtcaccgtctcctca

SEQ ID NO: 203 - DNA, 375 bp, Artificial Sequence
  Description of Artificial Sequence: Synthetic polynucleotide
caggtgcagctgcaggagtcgggcccaggactggtgaagccttcagagaccctgtccctcacctgcactgtctctggtggctccatcagcagtggtggttacttctggagctggatccgccagcccccagggaagggcctggagtggattgggtacatctattacagtgggaccacctactataacccgtccctcaagagtcgagttaccatatcaatagacacgtctaagaaccagttctccctgaagctgagctctgtgactgccgcggacacggccgtatattactgtgcgagagatcttttttactatgatagtagtggtcctagggggttcgagccctggggccagggaaccctggtcaccgtctcctca

SEQ ID NO: 204 - DNA, 375 bp, Artificial Sequence
  Description of Artificial Sequence: Synthetic polynucleotide
caggtgcagctgcaggagtcgggcccaggactggtgaagccttcagagaccctgtccctcacctgcactgtctctggtggctccatcagcagtggtggttacttctggagctggatccgccagcccccagggaagggcctggagtggattgggtacatctattacagtgggaccacctactataacccgtccctcaagagtcgagttaccatatcaatagacacgtctaagaaccagttctccctgaagctgagctctgtgactgccgcggacacggccgtatattactgtgcgagagatcttttttactatgagagtagtggtcctagggggttcgagccctggggccagggaaccctggtcaccgtctcctca

SEQ ID NO: 205 - DNA, 375 bp, Artificial Sequence
  Description of Artificial Sequence: Synthetic polynucleotide
caggtgcagctgcaggagtcgggcccaggactggtgaagccttcagagaccctgtccctcacctgcactgtctctggtggctccatcagcagtggtggttacttctggagctggatccgccagcccccagggaagggcctggagtggattgggtacatctattacagtgggaccacctactataacccgtccctcaagagtcgagttaccatatcaatagacacgtctaagaaccagttctccctgaagctgagctctgtgactgccgcggacacggccgtatattactgtgcgagagatcttttttactatgataccagtggtcctagggggttcgagccctggggccagggaaccctggtcaccgtctcctca

SEQ ID NO: 206 - DNA, 375 bp, Artificial Sequence
  Description of Artificial Sequence: Synthetic polynucleotide
caggtgcagctgcaggagtcgggcccaggactggtgaagccttcagagaccctgtccctcacctgcactgtctctggtggctccatcagcagtggtggttacttctggagctggatccgccagcccccagggaagggcctggagtggattgggtacatctattacagtgggaccacctactataacccgtccctcaagagtcgagttaccatatcaatagacacgtctaagaaccagttctccctgaagctgagctctgtgactgccgcggacacggccgtatattactgtgcgagagatcttttttactatgatagtagtggtcctagggggttcgacccctggggccagggaaccctggtcaccgtctcctca

SEQ ID NO: 207 - DNA, 375 bp, Artificial Sequence; identical to SEQ ID NO: 206
  Description of Artificial Sequence: Synthetic polynucleotide

SEQ ID NO: 208 - DNA, 375 bp, Artificial Sequence; identical to SEQ ID NO: 206
  Description of Artificial Sequence: Synthetic polynucleotide

SEQ ID NO: 209 - DNA, 375 bp, Artificial Sequence; identical to SEQ ID NO: 202
  Description of Artificial Sequence: Synthetic polynucleotide

SEQ ID NO: 210 - DNA, 375 bp, Artificial Sequence; identical to SEQ ID NO: 203
  Description of Artificial Sequence: Synthetic polynucleotide

SEQ ID NO: 211 - DNA, 375 bp, Artificial Sequence; identical to SEQ ID NO: 202
  Description of Artificial Sequence: Synthetic polynucleotide

SEQ ID NO: 212 - DNA, 375 bp, Artificial Sequence; identical to SEQ ID NO: 203
  Description of Artificial Sequence: Synthetic polynucleotide

SEQ ID NO: 213 - DNA, 375 bp, Artificial Sequence
  Description of Artificial Sequence: Synthetic polynucleotide
caggtgcagctgcaggagtcgggcccaggactggtgaagccttcagagaccctgtccctcacctgcactgtctctggtggctccatcagcagtggtggttacttctggagctggatccgccagcccccagggaagggcctggagtggattgggtacatctattacagtgggaccacctactataacccgtccctcaagagtcgagttaccatatcaatagacacgtctaagaaccagttctccctgaagctgagctctgtgactgccgcggacacggccgtatattactgtgcgagagatcttttttactatgatagtagtggtcctagggggttcgactactggggccagggaaccctggtcaccgtctcctca

SEQ ID NO: 214 - DNA, 375 bp, Artificial Sequence; identical to SEQ ID NO: 205
  Description of Artificial Sequence: Synthetic polynucleotide

SEQ ID NO: 215 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtggatggcagttatatggtatgttggaagtaataaatactatgcagactccgtgaagggccgattcaccatctccagagacaattccaagaacacgctgtatctgcaaatgaacagcctgagagccgaggacacggctgtgtattactgtgcgagaggtggagaactggggagagactactactccggtatggacgtctggggccaagggaccacggtcaccgtctcctca

SEQ ID NO: 216 - DNA, 369 bp, Artificial Sequence; identical to SEQ ID NO: 215
  Description of Artificial Sequence: Synthetic polynucleotide

SEQ ID NO: 217 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtggatggcagttatatggtatgttggaagtaataaatactatgcagagtccgtgaagggccgattcaccatctccagagacaattccaagaacacgctgtatctgcaaatgaacagcctgagagccgaggacacggctgtgtattactgtgcgagaggtggagaactggggagagactactactccggtatggacgtctggggccaagggaccacggtcaccgtctcctca

SEQ ID NO: 218 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtggatggcagttatatggtatgttggaagtaataaatactatgcagacaccgtgaagggccgattcaccatctccagagacaattccaagaacacgctgtatctgcaaatgaacagcctgagagccgaggacacggctgtgtattactgtgcgagaggtggagaactggggagagactactactccggtatggacgtctggggccaagggaccacggtcaccgtctcctca

SEQ ID NO: 219 - DNA, 369 bp, Artificial Sequence; identical to SEQ ID NO: 217
  Description of Artificial Sequence: Synthetic polynucleotide

SEQ ID NO: 220 - DNA, 369 bp, Artificial Sequence; identical to SEQ ID NO: 117
  Description of Artificial Sequence: Synthetic polynucleotide

SEQ ID NO: 221 - DNA, 369 bp, Artificial Sequence; identical to SEQ ID NO: 117
  Description of Artificial Sequence: Synthetic polynucleotide

SEQ ID NO: 222 - DNA, 369 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagttatggcatgcactggatccgccaggctccaggcaaggggctggagtgggtggcagttatatggtatgaaggaagtaataaatattatgcagagtccgtgaagggccgattcaccatctccagagacaattccaagaacacgctgtatctgcaaatgaacagcctgagagccgaggacacggctgtgtattactgtgcgagagggggtagactggggaaggactactactccggtatggacgtctggggccaagggaccacggtcaccgtctcctca

SEQ ID NO: 223 - DNA, 369 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagttatggcatgcactggatccgccaggctccaggcaaggggctggagtgggtggcagttatatggtatgaaggaagtaataaatattatgcagacaccgtgaagggccgattcaccatctccagagacaattccaagaacacgctgtatctgcaaatgaacagcctgagagccgaggacacggctgtgtattactgtgcgagagggggtagactggggaaggactactactccggtatggacgtctggggccaagggaccacggtcaccgtctcctca

SEQ ID NO: 224 - DNA, 369 bp, Artificial Sequence; identical to SEQ ID NO: 222
  Description of Artificial Sequence: Synthetic polynucleotide

SEQ ID NO: 225 - DNA, 369 bp, Artificial Sequence; identical to SEQ ID NO: 223
  Description of Artificial Sequence: Synthetic polynucleotide

SEQ ID NO: 226 - DNA, 369 bp, Artificial Sequence; identical to SEQ ID NO: 100
  Description of Artificial Sequence: Synthetic polynucleotide

SEQ ID NO: 227 - DNA, 369 bp, Artificial Sequence
  Description of Artificial Sequence: Synthetic polynucleotide
caggtgcaggtggtggagtctgggggaggcgtggtccagcctgggaggtccctgagactctcctgtgcagcgtctggattcaccttcagtagctatggcatgcactgggtccgccaggctccaggcaaggggctggagtgggtgtcagttatatggtatgaaggaagtaataaatactatgcagagtccgtgaagggccgattcaccatctccagagacaattccaagaacacgctgtatctgcaaatgaacagcctgagagccgaggacacggctgtgtattactgtgcgagaggaggtcttttgggttactactactactacggtatggacgtctggggccaagggaccacggtcaccgtctcctca

SEQ ID NO: 228 - DNA, 369 bp, Artificial Sequence
  Description of Artificial Sequence: Synthetic polynucleotide
caggtgcaggtggtggagtctgggggaggcgtggtccagcctgggaggtccctgagactctcctgtgcagcgtctggattcaccttcagtagctatggcatgcactgggtccgccaggctccaggcaaggggctggagtgggtgtcagttatatggtatgaaggaagtaataaatactatgcagacaccgtgaagggccgattcaccatctccagagacaattccaagaacacgctgtatctgcaaatgaacagcctgagagccgaggacacggctgtgtattactgtgcgagaggaggtcttttgggttactactactactacggtatggacgtctggggccaagggaccacggtcaccgtctcctca

SEQ ID NO: 229 - DNA, 369 bp, Artificial Sequence; identical to SEQ ID NO: 227
  Description of Artificial Sequence: Synthetic polynucleotide

SEQ ID NO: 230 - DNA, 369 bp, Artificial Sequence; identical to SEQ ID NO: 228
  Description of Artificial Sequence: Synthetic polynucleotide

SEQ ID NO: 231 - DNA, 369 bp, Artificial Sequence; identical to SEQ ID NO: 105
  Description of Artificial Sequence: Synthetic polynucleotide

SEQ ID NO: 232 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatcctggaagtaataaatactatgcagagtccgtgaagggccgattcaccatctccagagacaattccaagaacacgctgtatctgcaaatgaacagcctgagagccgaggacacggctgtgtattactgtgcgagagggggggaactggggaggtactactactacggtatggacgtctggggccaagggaccacggtcaccgtctcctca

SEQ ID NO: 233 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatcctggaagtaataaatactatgcagacaccgtgaagggccgattcaccatctccagagacaattccaagaacacgctgtatctgcaaatgaacagcctgagagccgaggacacggctgtgtattactgtgcgagagggggggaactggggaggtactactactacggtatggacgtctggggccaagggaccacggtcaccgtctcctca

SEQ ID NO: 234 - DNA, 369 bp, Artificial Sequence; identical to SEQ ID NO: 232
  Description of Artificial Sequence: Synthetic polynucleotide

SEQ ID NO: 235 - DNA, 369 bp, Artificial Sequence; identical to SEQ ID NO: 233
  Description of Artificial Sequence: Synthetic polynucleotide

SEQ ID NO: 236 - protein, 111 aa, Artificial Sequence
  Description of Artificial Sequence: Synthetic polypeptide
QSALTQPASVSGSPGQSITISCTGTSSDVGTYNLVSWYQQHPGKAPKLMIYEVSKRPSGVSNRFSGSKSGNTASLTISGLQAEDEADYYCASYAGFSTWVFGGGTKLTVLG

SEQ ID NO: 237 - protein, 111 aa, Artificial Sequence
  Description of Artificial Sequence: Synthetic polypeptide
QSALTQPASVSGSPGQSITISCTGTSSDVGTYNLVSWYQQHPGKAPKLMIYEVSKRPSGISNRFSGSKSGNTASLTISGLQAEDEADYYCASYAGYSTWVFGGGTKLTVLR

SEQ ID NO: 238 - protein, 108 aa, Artificial Sequence; identical to SEQ ID NO: 131
  Description of Artificial Sequence: Synthetic polypeptide

SEQ ID NO: 239 - protein, 111 aa, Artificial Sequence
  Description of Artificial Sequence: Synthetic polypeptide
QSALTQPASVSGSPGQSITISCTGTSSDVGIYNLVSWYQQHPGKAPKLMIHEVSKRPSGVSNRFSGSKSGNTASLTISGLQAEDEADYYCASYAGISTWVFGGGTKLTVLG

SEQ ID NO: 240 - protein, 108 aa, Artificial Sequence; identical to SEQ ID NO: 133
  Description of Artificial Sequence: Synthetic polypeptide

SEQ ID NO: 241 - protein, 109 aa, Artificial Sequence; identical to SEQ ID NO: 134
  Description of Artificial Sequence: Synthetic polypeptide

SEQ ID NO: 242 - protein, 109 aa, Artificial Sequence; identical to SEQ ID NO: 134
  Description of Artificial Sequence: Synthetic polypeptide

SEQ ID NO: 243 - protein, 109 aa, Artificial Sequence; identical to SEQ ID NO: 134
  Description of Artificial Sequence: Synthetic polypeptide

SEQ ID NO: 244 - protein, 109 aa, Artificial Sequence; identical to SEQ ID NO: 134
  Description of Artificial Sequence: Synthetic polypeptide

SEQ ID NO: 245 - protein, 109 aa, Artificial Sequence; identical to SEQ ID NO: 134
  Description of Artificial Sequence: Synthetic polypeptide

SEQ ID NO: 246 - protein, 109 aa, Artificial Sequence; identical to SEQ ID NO: 134
  Description of Artificial Sequence: Synthetic polypeptide

SEQ ID NO: 247 - protein, 109 aa, Artificial Sequence
  Description of Artificial Sequence: Synthetic polypeptide
EIVLTQSPGTLSLSPGERATLSCRASQTVSSNYLAWYQQKPGQAPRLLIYGSSTRATGIPDRFSGSGSGTDFTLTISRLEPEDFAVYYCQQYESSPWTFGQGTKVEIKR

SEQ ID NO: 248 - protein, 109 aa, Artificial Sequence
  Description of Artificial Sequence: Synthetic polypeptide
EIVLTQSPGTLSLSPGERATLSCRASQTVSSNYLAWYQQKPGQAPRLLIYGSSTRATGIPDRFSGSGSGTDFTLTISRLEPEDFAVYYCQQYDTSPWTFGQGTKVEIKR

SEQ ID NO: 249 - protein, 109 aa, Artificial Sequence; identical to SEQ ID NO: 247
  Description of Artificial Sequence: Synthetic polypeptide

SEQ ID NO: 250 - protein, 109 aa, Artificial Sequence; identical to SEQ ID NO: 247
  Description of Artificial Sequence: Synthetic polypeptide

SEQ ID NO: 251 - protein, 109 aa, Artificial Sequence; identical to SEQ ID NO: 248
  Description of Artificial Sequence: Synthetic polypeptide

SEQ ID NO: 252 - protein, 109 aa, Artificial Sequence; identical to SEQ ID NO: 248
  Description of Artificial Sequence: Synthetic polypeptide

SEQ ID NO: 253 - protein, 109 aa, Artificial Sequence; identical to SEQ ID NO: 248
  Description of Artificial Sequence: Synthetic polypeptide

SEQ ID NO: 254 - protein, 109 aa, Artificial Sequence; identical to SEQ ID NO: 247
  Description of Artificial Sequence: Synthetic polypeptide

SEQ ID NO: 255 - protein, 108 aa, Artificial Sequence; identical to SEQ ID NO: 135
  Description of Artificial Sequence: Synthetic polypeptide

SEQ ID NO: 256 - protein, 108 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTEFTLTISSLQPEDFATYYCQQHNSYPWTFGQGTKVEIKR

SEQ ID NO: 257 - protein, 108 aa, Artificial Sequence; identical to SEQ ID NO: 135
  Description of Artificial Sequence: Synthetic polypeptide

SEQ ID NO: 258 - protein, 108 aa, Artificial Sequence; identical to SEQ ID NO: 135
  Description of Artificial Sequence: Synthetic polypeptide

SEQ ID NO: 259 - protein, 108 aa, Artificial Sequence; identical to SEQ ID NO: 256
  Description of Artificial Sequence: Synthetic polypeptide

SEQ ID NO: 260 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYATSSLQSGVPSRFSGSGSGTEFTLTISSLQPEDFATYYCLQHNTYPWTFGQGTKVEIKR

SEQ ID NO: 261 - protein, 108 aa, Artificial Sequence
  Description of Artificial Sequence: Synthetic polypeptide
DIQMTQSPSSLSASVGDRVTITCRASQGIRNDLGWYQQKPGKAPKLLIYATSSLQSGVPSRFSGSGSGTEFTLTISSLQPEDFATYYCLQHNTYPWTFGQGTKVEIKR

SEQ ID NO: 262 - protein, 108 aa, Artificial Sequence; identical to SEQ ID NO: 260
  Description of Artificial Sequence: Synthetic polypeptide

SEQ ID NO: 263 - protein, 108 aa, Artificial Sequence; identical to SEQ ID NO: 260
  Description of Artificial Sequence: Synthetic polypeptide

SEQ ID NO: 264 - protein, 108 aa, Artificial Sequence; identical to SEQ ID NO: 261
  Description of Artificial Sequence: Synthetic polypeptide

SEQ ID NO: 265 - protein, 108 aa, Artificial Sequence; identical to SEQ ID NO: 261
  Description of Artificial Sequence: Synthetic polypeptide

SEQ ID NO: 266 - protein, 108 aa, Artificial Sequence
  Description of Artificial Sequence: Synthetic polypeptide
DIQMTQSPSSLSASVGDRVTITCRASQGIRNDLGWYQQKPGKAPKLLIYDASSLQSGVPSRFSGSGSGTEFTLTISSLQPEDFATYYCLQHHSYPWTFGQGTKVEIKR

SEQ ID NO: 267 - protein, 108 aa, Artificial Sequence; identical to SEQ ID NO: 119
  Description of Artificial Sequence: Synthetic polypeptide

SEQ ID NO: 268 - protein, 108 aa, Artificial Sequence; identical to SEQ ID NO: 119
  Description of Artificial Sequence: Synthetic polypeptide

SEQ ID NO: 269 - protein, 108 aa, Artificial Sequence; identical to SEQ ID NO: 266
  Description of Artificial Sequence: Synthetic polypeptide

SEQ ID NO: 270 - protein, 108 aa, Artificial Sequence; identical to SEQ ID NO: 266
  Description of Artificial Sequence: Synthetic polypeptide

SEQ ID NO: 271 - protein, 108 aa, Artificial Sequence
  Description of Artificial Sequence: Synthetic polypeptide
DIQMTQSPSSLSASVGDRVTVTCRASQGIRNDLGWYQQKPGKAPKLLIYAASSLQSGVPSRFSGSGSGTEFTLTISSLQPEDFATYYCLQHNNYPWTFGQGTKVDIKR

SEQ ID NO: 272 - protein, 108 aa, Artificial Sequence; identical to SEQ ID NO: 124
  Description of Artificial Sequence: Synthetic polypeptide

SEQ ID NO: 273 - protein, 108 aa, Artificial Sequence; identical to SEQ ID NO: 124
  Description of Artificial Sequence: Synthetic polypeptide

SEQ ID NO: 274 - protein, 108 aa, Artificial Sequence; identical to SEQ ID NO: 271
  Description of Artificial Sequence: Synthetic polypeptide

SEQ ID NO: 275 - protein, 108 aa, Artificial Sequence; identical to SEQ ID NO: 271
  Description of Artificial Sequence: Synthetic polypeptide

SEQ ID NO: 276 - protein, 120 aa, Artificial Sequence; identical to SEQ ID NO: 145
  Description of Artificial Sequence: Synthetic polypeptide

SEQ ID NO: 277 - protein, 117 aa, Artificial Sequence; identical to SEQ ID NO: 146
  Description of Artificial Sequence: Synthetic polypeptide

SEQ ID NO: 278 - protein, 123 aa, Artificial Sequence
  Description of Artificial Sequence: Synthetic polypeptide
QMQLVESGGGVVQPGGSLRLSCAASGFTFSSYGMHWVRQAPGKGLEWVAVIWYAGSNKYYADSVKGRFTISRDNSKNTLYLQMNSLRAEDTAVYYCARGGRLGFYYYYGMDVWGQGTTVTVSS

SEQ ID NO: 279 - protein, 117 aa, Artificial Sequence; identical to SEQ ID NO: 151
  Description of Artificial Sequence: Synthetic polypeptide

SEQ ID NO: 280 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDLRYNWNDGGVDYWGQGTLVTVSS

SEQ ID NO: 281 - protein, 125 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYESSGPRGFDPWGQGTLVTVSS

SEQ ID NO: 282 - protein, 125 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDTSGPRGFDPWGQGTLVTVSS

SEQ ID NO: 283 - protein, 125 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDSSGPRGFEPWGQGTLVTVSS

SEQ ID NO: 284 - protein, 125 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYESSGPRGFEPWGQGTLVTVSS

SEQ ID NO: 285 - protein, 125 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDTSGPRGFEPWGQGTLVTVSS

SEQ ID NO: 286 - protein, 125 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDSSGPRGFDPWGQGTLVTVSS

SEQ ID NO: 287 - protein, 125 aa, Artificial Sequence; identical to SEQ ID NO: 286
  Description of Artificial Sequence: Synthetic polypeptide

SEQ ID NO: 288 - protein, 125 aa, Artificial Sequence; identical to SEQ ID NO: 286
  Description of Artificial Sequence: Synthetic polypeptide

SEQ ID NO: 289 - protein, 125 aa, Artificial Sequence; identical to SEQ ID NO: 282
  Description of Artificial Sequence: Synthetic polypeptide

SEQ ID NO: 290 - protein, 125 aa, Artificial Sequence; identical to SEQ ID NO: 283
  Description of Artificial Sequence: Synthetic polypeptide

SEQ ID NO: 291 - protein, 125 aa, Artificial Sequence; identical to SEQ ID NO: 282
  Description of Artificial Sequence: Synthetic polypeptide

SEQ ID NO: 292 - protein, 125 aa, Artificial Sequence; identical to SEQ ID NO: 283
  Description of Artificial Sequence: Synthetic polypeptide

SEQ ID NO: 293 - protein, 125 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDSSGPRGFDYWGQGTLVTVSS

SEQ ID NO: 294 - protein, 125 aa, Artificial Sequence; identical to SEQ ID NO: 285
  Description of Artificial Sequence: Synthetic polypeptide

SEQ ID NO: 295 - protein, 123 aa, Artificial Sequence
  Description of Artificial Sequence: Synthetic polypeptide
QVQLVESGGGVVQPGRSLRLSCAASGFTFSSYGMHWVRQAPGKGLEWMAVIWYVGSNKYYADSVKGRFTISRDNSKNTLYLQMNSLRAEDTAVYYCARGGELGRDYYSGMDVWGQGTTVTVSS

SEQ ID NO: 296 - protein, 123 aa, Artificial Sequence; identical to SEQ ID NO: 295
  Description of Artificial Sequence: Synthetic polypeptide

SEQ ID NO: 297 - protein, 123 aa, Artificial Sequence
  Description of Artificial Sequence: Synthetic polypeptide
QVQLVESGGGVVQPGRSLRLSCAASGFTFSSYGMHWVRQAPGKGLEWMAVIWYVGSNKYYAESVKGRFTISRDNSKNTLYLQMNSLRAEDTAVYYCARGGELGRDYYSGMDVWGQGTTVTVSS

SEQ ID NO: 298 - protein, 123 aa, Artificial Sequence
  Description of Artificial Sequence: Synthetic polypeptide
QVQLVESGGGVVQPGRSLRLSCAASGFTFSSYGMHWVRQAPGKGLEWMAVIWYVGSNKYYADTVKGRFTISRDNSKNTLYLQMNSLRAEDTAVYYCARGGELGRDYYSGMDVWGQGTTVTVSS

SEQ ID NO: 299 - protein, 123 aa, Artificial Sequence; identical to SEQ ID NO: 297
  Description of Artificial Sequence: Synthetic polypeptide

SEQ ID NO: 300 - protein, 123 aa, Artificial Sequence; identical to SEQ ID NO: 155
  Description of Artificial Sequence: Synthetic polypeptide

SEQ ID NO: 301 - protein, 123 aa, Artificial Sequence; identical to SEQ ID NO: 155
  Description of Artificial Sequence: Synthetic polypeptide

SEQ ID NO: 302 - protein, 123 aa, Artificial Sequence
  Description of Artificial Sequence: Synthetic polypeptide
QVQLVESGGGVVQPGRSLRLSCVASGFTFSSYGMHWIRQAPGKGLEWVAVIWYEGSNKYYAESVKGRFTISRDNSKNTLYLQMNSLRAEDTAVYYCARGGRLGKDYYSGMDVWGQGTTVTVSS

SEQ ID NO: 303 - protein, 123 aa, Artificial Sequence
  Description of Artificial Sequence: Synthetic polypeptide
QVQLVESGGGVVQPGRSLRLSCVASGFTFSSYGMHWIRQAPGKGLEWVAVIWYEGSNKYYADTVKGRFTISRDNSKNTLYLQMNSLRAEDTAVYYCARGGRLGKDYYSGMDVWGQGTTVTVSS

SEQ ID NO: 304 - protein, 123 aa, Artificial Sequence; identical to SEQ ID NO: 302
  Description of Artificial Sequence: Synthetic polypeptide

SEQ ID NO: 305 - protein, 123 aa, Artificial Sequence; identical to SEQ ID NO: 303
  Description of Artificial Sequence: Synthetic polypeptide

SEQ ID NO: 306 - protein, 123 aa, Artificial Sequence; identical to SEQ ID NO: 138
  Description of Artificial Sequence: Synthetic polypeptide

SEQ ID NO: 307 - protein, 123 aa, Artificial Sequence
  Description of Artificial Sequence: Synthetic polypeptide
QVQVVESGGGVVQPGRSLRLSCAASGFTFSSYGMHWVRQAPGKGLEWVSVIWYEGSNKYYAESVKGRFTISRDNSKNTLYLQMNSLRAEDTAVYYCARGGLLGYYYYYGMDVWGQGTTVTVSS

SEQ ID NO: 308 - protein, 123 aa, Artificial Sequence
  Description of Artificial Sequence: Synthetic polypeptide
QVQVVESGGGVVQPGRSLRLSCAASGFTFSSYGMHWVRQAPGKGLEWVSVIWYEGSNKYYADTVKGRFTISRDNSKNTLYLQMNSLRAEDTAVYYCARGGLLGYYYYYGMDVWGQGTTVTVSS

SEQ ID NO: 309 - protein, 123 aa, Artificial Sequence; identical to SEQ ID NO: 307
  Description of Artificial Sequence: Synthetic polypeptide

SEQ ID NO: 310 - protein, 123 aa, Artificial Sequence; identical to SEQ ID NO: 308
  Description of Artificial Sequence: Synthetic polypeptide

SEQ ID NO: 311 - protein, 123 aa, Artificial Sequence; identical to SEQ ID NO: 143
  Description of Artificial Sequence: Synthetic polypeptide

SEQ ID NO: 312 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYPGSNKYYAESVKGRFTISRDNSKNTLYLQMNSLRAEDTAVYYCARGGELGRYYYYGMDVWGQGTTVTVSS

SEQ ID NO: 313 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYPGSNKYYADTVKGRFTISRDNSKNTLYLQMNSLRAEDTAVYYCARGGELGRYYYYGMDVWGQGTTVTVSS

SEQ ID NO: 314 - protein, 123 aa, Artificial Sequence; identical to SEQ ID NO: 312
  Description of Artificial Sequence: Synthetic polypeptide

SEQ ID NO: 315 - protein, 123 aa, Artificial Sequence; identical to SEQ ID NO: 313
  Description of Artificial Sequence: Synthetic polypeptide

SEQ ID NO: 316 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYDASSLQSGVPSRFSGSGSGTEFTLTISSLQPEDFATYYCLQHNNYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 317 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYDASSLQSGVPSRFSGSGSGTEFTLTISSLQPEDFATYYCLQHHSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 318 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTVSSLQPEDFATYYCLQLNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 319 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYDASSLQSGVPSRFSGSGSGTDFTLTISSLQPEDFATYYCLQLNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 320 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASTLQSGVPSRFSGSGSGTEFTLTISSLQPEDFATYYCLQHNNYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 321 - protein, 214 aa, Artificial Sequence
  Description of Artificial Sequence: Synthetic polypeptide
DIQMTQSPSSLSASVGDRVTITCRASQVIRNDLGWYQQKPGKAPKRLIYAASSLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - protein, 214 aa, Artificial Sequence
  Description of Artificial Sequence: Synthetic polypeptide
DIQMTQSPSSLSASVGDRVTVTCRASQGIRNDLGWYQQKPGKAPKRLIYAASSLQSGVPSRFSGSGSGTEFTLTISSLQPEDFATYYCLQHNNYPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 323 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYDASSLQSGVPSRFSGSGSGTDFTLTISSLQPEEFATYYCLQHNNYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 324 - protein, 216 aa, Artificial Sequence
  Description of Artificial Sequence: Synthetic polypeptide
QSALTQPASVSGSPGQSITISCTGTSSDVGTYNLVSWYQQHPGKAPKLMIYEVSKRPSGVSNRFSGSKSGNTASLTISGLQAEDEADYYCCSYAGFSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 325 - protein, 216 aa, Artificial Sequence
  Description of Artificial Sequence: Synthetic polypeptide
QSALTQPASVSGSPGQSITISCTGTSSDVGTYNLVSWYQQHPGKAPKLMIYEVSKRPSGISNRFSGSKSGNTASLTISGLQAEDEADYYCCSYAGYSTWVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 326 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGAEFTLTISSLQPEDFATYYCLQHNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNNYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 214 aa, Artificial Sequence
  Description of Artificial Sequence: Synthetic polypeptide
DIQMTQSPSSLSASVGDRVTITCRASQVIRNDLGWYQQKPGKAPKRLIYAASSLQSGVPSRFSGSGSGTEFTLTISSLQPEDFATYYCLQHNSYPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 216 aa, Artificial Sequence
  Description of Artificial Sequence: Synthetic polypeptide
QSALTQPASVSGSPGQSITISCTGTSSDVGIYNLVSWYQQHPGKAPKLMIHEVSKRPSGVSNRFSGSKSGNTASLTISGLQAEDEADYYCCSYAGISTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 331 - protein, 214 aa, Artificial Sequence
  Description of Artificial Sequence: Synthetic polypeptide
DIQMTQSPSSLSASVGDRVIITCRASQSISSYLHWYKQKPGKAPKLLIYGASRLQSGVPSRFSGSGSGTDFTLTISSLQPEDFATYYCQQSSSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 215 aa, Artificial Sequence
  Description of Artificial Sequence: Synthetic polypeptide
EIVLTQSPGTLSLSPGERATLSCRASQTVSSNYLAWYQQKPGQAPRLLIYGSSTRATGIPDRFSGSGSGTDFTLTISRLEPEDFAVYYCQQYDSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCQQHNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 334 - protein, 214 aa, Artificial Sequence
  Description of Artificial Sequence: Synthetic polypeptide
DIQMTQSPSSLSASVGDRVTITCRASQGIRNDLGWYQQKPGKAPNRLIYATSSLQSGVPSRFSGSGSGTEFTLTISSLQPEDFATYYCLQHNTYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - protein, 453 aa, Artificial Sequence
  Description of Artificial Sequence: Synthetic polypeptide
QVQLVESGGGVVQPGRSLRLSCAASGFTFSSYGMHWVRQAPGKGLEWVTVIWYEGSNKYYADSVKGRFTISRDNSKNTLYLQMNSLRAEDTAVYYCARGGQLGKYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 336 - protein, 453 aa, Artificial Sequence
  Description of Artificial Sequence: Synthetic polypeptide
QVQVVESGGGVVQPGRSLRLSCAASGFTFSSYGMHWVRQAPGKGLEWVSVIWYEGSNKYYADSVKGRFTISRDNSKNTLYLQMNSLRAEDTAVYYCARGGLLGYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 337 - protein, 453 aa, Artificial Sequence
  Description of Artificial Sequence: Synthetic polypeptide
QVQLVESGGGVVQPGRSLRLSCAASGFTFSNYGMHWVRQAPGKGLEWVAVIWYVGSNKYYADSVKGRFTISRDNSKNTLYLQMNSLRAEDTAVYYCARGGELRLYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 338 - protein, 453 aa, Artificial Sequence
  Description of Artificial Sequence: Synthetic polypeptide
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGQLGYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 339 - protein, 453 aa, Artificial Sequence
  Description of Artificial Sequence: Synthetic polypeptide
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGELSFYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 340 - protein, 453 aa, Artificial Sequence
  Description of Artificial Sequence: Synthetic polypeptide
QVQVVESGGGVVQPGRSLRLSCAASGFTFSSYGMYWVRQAPGKGLEWVAVIWYEGSNKYYADSVRGRFTISRDNSKNTLYLQMNSLRAEDTALYYCARGGQLGKDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 453 aa, Artificial Sequence
  Description of Artificial Sequence: Synthetic polypeptide
QVQLVESGGGVVQPGRSLRLSCAASGFTFSSYGMHWVRQAPGKGLEWVAVIWYPGSNKYYADSVKGRFTISRDNSKNTLYLQMNSLRAEDTAVYYCARGGELGRYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 342 - protein, 453 aa, Artificial Sequence
  Description of Artificial Sequence: Synthetic polypeptide
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGQLGYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 343 - protein, 450 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRFTISRDNSKNTLYLQMNSLRAEDTAVYYCARRGTVTTPDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 344 - protein, 447 aa, Artificial Sequence
  Description of Artificial Sequence: Synthetic polypeptide
QVQLVESGGGVVQPGRSLRLSCAASGFTFSSYGMHWVRQAPGKGLEWVAVIWHDGSNKYYADSVKGRFTISKDNSKNTLYLQMNSLRAEDTAVYYCAREYGGNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 345 - protein, 454 aa, Artificial Sequence
  Description of Artificial Sequence: Synthetic polypeptide
QVQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGDILTGYSLYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - protein, 453 aa, Artificial Sequence
  Description of Artificial Sequence: Synthetic polypeptide
QVQLVESGGGVVQPGRSLRLSCAASGFTFSSYGMHWVRQAPGKGLEWVAVIWYAGSNKYYADSVKGRFTISRDNSKNTVYLQMNSLRAEDTAVYYCARGGQLALYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 347 - protein, 453 aa, Artificial Sequence
  Description of Artificial Sequence: Synthetic polypeptide
QVQLVESGGGVVQPGRSLRLSCAASGFTFSSYGMYWVRQAPGKGLEWVAVIWYEGSNKYYADSVKGRFTISRDNSKNTLYLQMNSLRAEDTAVYFCARGGELGRDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 348 - protein, 453 aa, Artificial Sequence
  Description of Artificial Sequence: Synthetic polypeptide
QMQLVESGGGVVQPGRSLRLSCAASGFTFSSYGMHWVRQAPGKGLEWVAVIWYAGSNKYYADSVKGRFTISRDNSKNTLYLQMNSLRAEDTAVYYCARGGRLGFYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 349 - protein, 447 aa, Artificial Sequence
  Description of Artificial Sequence: Synthetic polypeptide
QVQLVESGGGVVQPGRSLRLSCAASGFTFSSYGMHWVRQAPGKGLEWVAVIWSDGNNKYYEDSVKGRFTISRDSSKNTLFLQMNSLRAEDTAVYYCARDTATPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 350 - protein, 452 aa, Artificial Sequence
  Description of Artificial Sequence: Synthetic polypeptide
QVQLVESGGGVVQPGRSLRLSCAASGFTFSSCGMHWVRQAPGKGLEWVAVISYDGSNKYYADSVKGRFTISRDNSKNTLYLQMNSLRAEDTAVYYCARDLRYNWNDGGVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 455 aa, Artificial Sequence
  Description of Artificial Sequence: Synthetic polypeptide
QVQLQESGPGLVKPSQTLSLTCTVSGGSISSGGYFWSWIRQHPGKGLEWIGYIYYSGTTYYNPSLKSRVTISIDTSKNHFSLKLSSVTAADTAVYYCARDLFYYDSSGPRGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 352 - protein, 453 aa, Artificial Sequence
  Description of Artificial Sequence: Synthetic polypeptide
QVQLVESGGGVVQPGRSLRLSCAASGFTFSSYGMHWVRQAPGKGLEWMAVIWYVGSNKYYADSVKGRFTISRDNSKNTLYLQMNSLSAEDTAVYYCARGGELGRDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - protein, 453 aa, Artificial Sequence
  Description of Artificial Sequence: Synthetic polypeptide
QVQLVESGGGVVQPGRSLRLSCVASGFTFSSYGMHWIRQAPGKGLEWVAVIWYEGSNKYYADSVKGRFTISRDNSKNTLYLQMNSLRAEDTAVYYCARGGRLGKDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 354 - protein, 216 aa, Artificial Sequence
  Description of Artificial Sequence: Synthetic polypeptide
QSALTQPASVSGSPGQSITISCTGTSSDVGTYNLVSWYQQHPGKAPKLMIYEVSKRPSGVSNRFSGSKSGNTASLTISGLQAEDEADYYCASYAGFSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 355 - protein, 216 aa, Artificial Sequence
  Description of Artificial Sequence: Synthetic polypeptide
QSALTQPASVSGSPGQSITISCTGTSSDVGTYNLVSWYQQHPGKAPKLMIYEVSKRPSGISNRFSGSKSGNTASLTISGLQAEDEADYYCASYAGYSTWVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 356 - protein, 214 aa, Artificial Sequence; identical to SEQ ID NO: 329
  Description of Artificial Sequence: Synthetic polypeptide

SEQ ID NO: 357 - protein, 216 aa, Artificial Sequence
  Description of Artificial Sequence: Synthetic polypeptide
QSALTQPASVSGSPGQSITISCTGTSSDVGIYNLVSWYQQHPGKAPKLMIHEVSKRPSGVSNRFSGSKSGNTASLTISGLQAEDEADYYCASYAGISTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 358 - protein, 214 aa, Artificial Sequence; identical to SEQ ID NO: 331
  Description of Artificial Sequence: Synthetic polypeptide

SEQ ID NO: 359 - protein, 215 aa, Artificial Sequence; identical to SEQ ID NO: 332
  Description of Artificial Sequence: Synthetic polypeptide

SEQ ID NO: 360 - protein, 215 aa, Artificial Sequence; identical to SEQ ID NO: 332
  Description of Artificial Sequence: Synthetic polypeptide

SEQ ID NO: 361 - protein, 215 aa, Artificial Sequence; identical to SEQ ID NO: 332
  Description of Artificial Sequence: Synthetic polypeptide

SEQ ID NO: 362 - protein, 215 aa, Artificial Sequence; identical to SEQ ID NO: 332
  Description of Artificial Sequence: Synthetic polypeptide

SEQ ID NO: 363 - protein, 215 aa, Artificial Sequence; identical to SEQ ID NO: 332
  Description of Artificial Sequence: Synthetic polypeptide

SEQ ID NO: 364 - protein, 215 aa, Artificial Sequence; identical to SEQ ID NO: 332
  Description of Artificial Sequence: Synthetic polypeptide

SEQ ID NO: 365 - protein, 215 aa, Artificial Sequence
  Description of Artificial Sequence: Synthetic polypeptide
EIVLTQSPGTLSLSPGERATLSCRASQTVSSNYLAWYQQKPGQAPRLLIYGSSTRATGIPDRFSGSGSGTDFTLTISRLEPEDFAVYYCQQYESSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 366 - protein, 215 aa, Artificial Sequence
  Description of Artificial Sequence: Synthetic polypeptide
EIVLTQSPGTLSLSPGERATLSCRASQTVSSNYLAWYQQKPGQAPRLLIYGSSTRATGIPDRFSGSGSGTDFTLTISRLEPEDFAVYYCQQYDTSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 367 - protein, 215 aa, Artificial Sequence; identical to SEQ ID NO: 365
  Description of Artificial Sequence: Synthetic polypeptide

SEQ ID NO: 368 - protein, 215 aa, Artificial Sequence; identical to SEQ ID NO: 365
  Description of Artificial Sequence: Synthetic polypeptide

SEQ ID NO: 369 - protein, 215 aa, Artificial Sequence; identical to SEQ ID NO: 366
  Description of Artificial Sequence: Synthetic polypeptide

SEQ ID NO: 370 - protein, 215 aa, Artificial Sequence; identical to SEQ ID NO: 366
  Description of Artificial Sequence: Synthetic polypeptide

SEQ ID NO: 371 - protein, 215 aa, Artificial Sequence; identical to SEQ ID NO: 366
  Description of Artificial Sequence: Synthetic polypeptide

SEQ ID NO: 372 - protein, 215 aa, Artificial Sequence; identical to SEQ ID NO: 365
  Description of Artificial Sequence: Synthetic polypeptide

SEQ ID NO: 373 - protein, 214 aa, Artificial Sequence; identical to SEQ ID NO: 333
  Description of Artificial Sequence: Synthetic polypeptide

SEQ ID NO: 374 - protein, 214 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTEFTLTISSLQPEDFATYYCQQHNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 375 - protein, 214 aa, Artificial Sequence; identical to SEQ ID NO: 333
  Description of Artificial Sequence: Synthetic polypeptide

SEQ ID NO: 376 - protein, 214 aa, Artificial Sequence; identical to SEQ ID NO: 333
  Description of Artificial Sequence: Synthetic polypeptide

SEQ ID NO: 377 - protein, 214 aa, Artificial Sequence; identical to SEQ ID NO: 374
  Description of Artificial Sequence: Synthetic polypeptide

SEQ ID NO: 378 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYATSSLQSGVPSRFSGSGSGTEFTLTISSLQPEDFATYYCLQHNTYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 379 - protein, 214 aa, Artificial Sequence
  Description of Artificial Sequence: Synthetic polypeptide
DIQMTQSPSSLSASVGDRVTITCRASQGIRNDLGWYQQKPGKAPKLLIYATSSLQSGVPSRFSGSGSGTEFTLTISSLQPEDFATYYCLQHNTYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - protein, 214 aa, Artificial Sequence; identical to SEQ ID NO: 378
  Description of Artificial Sequence: Synthetic polypeptide

SEQ ID NO: 381 - protein, 214 aa, Artificial Sequence; identical to SEQ ID NO: 378
  Description of Artificial Sequence: Synthetic polypeptide

SEQ ID NO: 382 - protein, 214 aa, Artificial Sequence; identical to SEQ ID NO: 379
  Description of Artificial Sequence: Synthetic polypeptide

SEQ ID NO: 383 - protein, 214 aa, Artificial Sequence; identical to SEQ ID NO: 379
  Description of Artificial Sequence: Synthetic polypeptide

SEQ ID NO: 384 - protein, 214 aa, Artificial Sequence
  Description of Artificial Sequence: Synthetic polypeptide
DIQMTQSPSSLSASVGDRVTITCRASQGIRNDLGWYQQKPGKAPKLLIYDASSLQSGVPSRFSGSGSGTEFTLTISSLQPEDFATYYCLQHHSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 385 - protein, 214 aa, Artificial Sequence; identical to SEQ ID NO: 317
  Description of Artificial Sequence: Synthetic polypeptide

SEQ ID NO: 386 - protein, 214 aa, Artificial Sequence; identical to SEQ ID NO: 317
  Description of Artificial Sequence: Synthetic polypeptide

SEQ ID NO: 387 - protein, 214 aa, Artificial Sequence; identical to SEQ ID NO: 384
  Description of Artificial Sequence: Synthetic polypeptide

SEQ ID NO: 388 - protein, 214 aa, Artificial Sequence; identical to SEQ ID NO: 384
  Description of Artificial Sequence: Synthetic polypeptide

SEQ ID NO: 389 - protein, 214 aa, Artificial Sequence
  Description of Artificial Sequence: Synthetic polypeptide
DIQMTQSPSSLSASVGDRVTVTCRASQGIRNDLGWYQQKPGKAPKLLIYAASSLQSGVPSRFSGSGSGTEFTLTISSLQPEDFATYYCLQHNNYPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - protein, 214 aa, Artificial Sequence; identical to SEQ ID NO: 322
  Description of Artificial Sequence: Synthetic polypeptide

SEQ ID NO: 391 - protein, 214 aa, Artificial Sequence; identical to SEQ ID NO: 322
  Description of Artificial Sequence: Synthetic polypeptide

SEQ ID NO: 392 - protein, 214 aa, Artificial Sequence; identical to SEQ ID NO: 389
  Description of Artificial Sequence: Synthetic polypeptide

SEQ ID NO: 393 - protein, 214 aa, Artificial Sequence; identical to SEQ ID NO: 389
  Description of Artificial Sequence: Synthetic polypeptide

SEQ ID NO: 394 - protein, 450 aa, Artificial Sequence; identical to SEQ ID NO: 343
  Description of Artificial Sequence: Synthetic polypeptide

SEQ ID NO: 395 - protein, 447 aa, Artificial Sequence; identical to SEQ ID NO: 344
  Description of Artificial Sequence: Synthetic polypeptide

SEQ ID NO: 396 - protein, 453 aa, Artificial Sequence
  Description of Artificial Sequence: Synthetic polypeptide
QMQLVESGGGVVQPGGSLRLSCAASGFTFSSYGMHWVRQAPGKGLEWVAVIWYAGSNKYYADSVKGRFTISRDNSKNTLYLQMNSLRAEDTAVYYCARGGRLGFYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 397 - protein, 447 aa, Artificial Sequence; identical to SEQ ID NO: 349
  Description of Artificial Sequence: Synthetic polypeptide

SEQ ID NO: 398 - protein, 452 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDLRYNWNDGGVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - protein, 455 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYESSGPRGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - protein, 455 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDTSGPRGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 455 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDSSGPRGFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 455 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYESSGPRGFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 455 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDTSGPRGFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 404 - protein, 455 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDSSGPRGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 455 aa, Artificial Sequence; identical to SEQ ID NO: 404
  Description of Artificial Sequence: Synthetic polypeptide

SEQ ID NO: 406 - protein, 455 aa, Artificial Sequence; identical to SEQ ID NO: 404
  Description of Artificial Sequence: Synthetic polypeptide

SEQ ID NO: 407 - protein, 455 aa, Artificial Sequence; identical to SEQ ID NO: 400
  Description of Artificial Sequence: Synthetic polypeptide

SEQ ID NO: 408 - protein, 455 aa, Artificial Sequence; identical to SEQ ID NO: 401
  Description of Artificial Sequence: Synthetic polypeptide

SEQ ID NO: 409 - protein, 455 aa, Artificial Sequence; identical to SEQ ID NO: 400
  Description of Artificial Sequence: Synthetic polypeptide

SEQ ID NO: 410 - protein, 455 aa, Artificial Sequence; identical to SEQ ID NO: 401
  Description of Artificial Sequence: Synthetic polypeptide

SEQ ID NO: 411 - protein, 455 aa, Artificial Sequence
  Description of Artificial Sequence: Synthetic polypeptide
QVQLQESGPGLVKPSETLSLTCTVSGGSISSGGYFWSWIRQPPGKGLEWIGYIYYSGTTYYNPSLKSRVTISIDTSKNQFSLKLSSVTAADTAVYYCARDLFYYDSSGPRGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 412 - protein, 455 aa, Artificial Sequence; identical to SEQ ID NO: 403
  Description of Artificial Sequence: Synthetic polypeptide

SEQ ID NO: 413 - protein, 453 aa, Artificial Sequence
  Description of Artificial Sequence: Synthetic polypeptide
QVQLVESGGGVVQPGRSLRLSCAASGFTFSSYGMHWVRQAPGKGLEWMAVIWYVGSNKYYADSVKGRFTISRDNSKNTLYLQMNSLRAEDTAVYYCARGGELGRDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 453 aa, Artificial Sequence; identical to SEQ ID NO: 413
  Description of Artificial Sequence: Synthetic polypeptide

SEQ ID NO: 415 - protein, 453 aa, Artificial Sequence
  Description of Artificial Sequence: Synthetic polypeptide
QVQLVESGGGVVQPGRSLRLSCAASGFTFSSYGMHWVRQAPGKGLEWMAVIWYVGSNKYYAESVKGRFTISRDNSKNTLYLQMNSLRAEDTAVYYCARGGELGRDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 416 - protein, 453 aa, Artificial Sequence
  Description of Artificial Sequence: Synthetic polypeptide
QVQLVESGGGVVQPGRSLRLSCAASGFTFSSYGMHWVRQAPGKGLEWMAVIWYVGSNKYYADTVKGRFTISRDNSKNTLYLQMNSLRAEDTAVYYCARGGELGRDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 453 aa, Artificial Sequence; identical to SEQ ID NO: 415
  Description of Artificial Sequence: Synthetic polypeptide

SEQ ID NO: 418 - protein, 453 aa, Artificial Sequence; identical to SEQ ID NO: 353
  Description of Artificial Sequence: Synthetic polypeptide

SEQ ID NO: 419 - protein, 453 aa, Artificial Sequence; identical to SEQ ID NO: 353
  Description of Artificial Sequence: Synthetic polypeptide

SEQ ID NO: 420 - protein, 453 aa, Artificial Sequence
  Description of Artificial Sequence: Synthetic polypeptide
QVQLVESGGGVVQPGRSLRLSCVASGFTFSSYGMHWIRQAPGKGLEWVAVIWYEGSNKYYAESVKGRFTISRDNSKNTLYLQMNSLRAEDTAVYYCARGGRLGKDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - protein, 453 aa, Artificial Sequence
  Description of Artificial Sequence: Synthetic polypeptide
QVQLVESGGGVVQPGRSLRLSCVASGFTFSSYGMHWIRQAPGKGLEWVAVIWYEGSNKYYADTVKGRFTISRDNSKNTLYLQMNSLRAEDTAVYYCARGGRLGKDYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 422 - protein, 453 aa, Artificial Sequence; identical to SEQ ID NO: 420
  Description of Artificial Sequence: Synthetic polypeptide

SEQ ID NO: 423 - protein, 453 aa, Artificial Sequence; identical to SEQ ID NO: 421
  Description of Artificial Sequence: Synthetic polypeptide

SEQ ID NO: 424 - protein, 453 aa, Artificial Sequence; identical to SEQ ID NO: 336
  Description of Artificial Sequence: Synthetic polypeptide

SEQ ID NO: 425 - protein, 453 aa, Artificial Sequence
  Description of Artificial Sequence: Synthetic polypeptide
QVQVVESGGGVVQPGRSLRLSCAASGFTFSSYGMHWVRQAPGKGLEWVSVIWYEGSNKYYAESVKGRFTISRDNSKNTLYLQMNSLRAEDTAVYYCARGGLLGYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - protein, 453 aa, Artificial Sequence
  Description of Artificial Sequence: Synthetic polypeptide
QVQVVESGGGVVQPGRSLRLSCAASGFTFSSYGMHWVRQAPGKGLEWVSVIWYEGSNKYYADTVKGRFTISRDNSKNTLYLQMNSLRAEDTAVYYCARGGLLGYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 427 - protein, 453 aa, Artificial Sequence; identical to SEQ ID NO: 425
  Description of Artificial Sequence: Synthetic polypeptide

SEQ ID NO: 428 - protein, 453 aa, Artificial Sequence; identical to SEQ ID NO: 426
  Description of Artificial Sequence: Synthetic polypeptide

SEQ ID NO: 429 - protein, 453 aa, Artificial Sequence; identical to SEQ ID NO: 341
  Description of Artificial Sequence: Synthetic polypeptide

SEQ ID NO: 430 - protein, 453 aa, Artificial Sequence
  Description of Artificial Sequence: Synthetic polypeptide
QVQLVESGGGVVQPGRSLRLSCAASGFTFSSYGMHWVRQAPGKGLEWVAVIWYPGSNKYYAESVKGRFTISRDNSKNTLYLQMNSLRAEDTAVYYCARGGELGRYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 453 aa, Artificial Sequence
  Description of Artificial Sequence: Synthetic polypeptide
QVQLVESGGGVVQPGRSLRLSCAASGFTFSSYGMHWVRQAPGKGLEWVAVIWYPGSNKYYADTVKGRFTISRDNSKNTLYLQMNSLRAEDTAVYYCARGGELGRYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 432 - protein, 453 aa, Artificial Sequence; identical to SEQ ID NO: 430
  Description of Artificial Sequence: Synthetic polypeptide

SEQ ID NO: 433 - protein, 453 aa, Artificial Sequence; identical to SEQ ID NO: 431
  Description of Artificial Sequence: Synthetic polypeptide

SEQ ID NO: 434 - protein, 10 aa, Artificial Sequence
  Description of Artificial Sequence: Synthetic peptide
ASYAGISTWV

SEQ ID NO: 435 - protein, 15 aa, Artificial Sequence
  Description of Artificial Sequence: Synthetic peptide
DLFYYDSSGPRGFDY

SEQ ID NO: 436 - protein, 5 aa, Artificial Sequence
  Description of Artificial Sequence: Synthetic peptide
  MOD_RES (1)..(1): Ser or Asn
  MOD_RES (5)..(5): His or Tyr
XYGMX

SEQ ID NO: 437 - protein, 17 aa, Artificial Sequence
  Description of Artificial Sequence: Synthetic peptide
  MOD_RES (5)..(5): Glu, Val, Ala or Pro
  MOD_RES (16)..(16): Lys or Arg
VIWYXGSNKYYADSVXG

SEQ ID NO: 438 - protein, 14 aa, Artificial Sequence
  Description of Artificial Sequence: Synthetic peptide
  MOD_RES (3)..(3): Gln, Leu, Glu or Arg
  MOD_RES (5)..(5): Gly, Arg or Ser
  MOD_RES (6)..(6): Lys, Tyr, Leu, Phe or Arg
  MOD_RES (7)..(7): Tyr or Asp
  MOD_RES (10)..(10): Tyr or Ser
GGXLXXXYYXGMDV

SEQ ID NO: 439 - protein, 11 aa, Artificial Sequence
  Description of Artificial Sequence: Synthetic peptide
  MOD_RES (5)..(5): Gly or Val
RASQXIRNDLG

SEQ ID NO: 440 - protein, 7 aa, Artificial Sequence
  Description of Artificial Sequence: Synthetic peptide
  MOD_RES (1)..(1): Ala or Asp
  MOD_RES (2)..(2): Ala or Thr
  MOD_RES (4)..(4): Ser or Thr
XXSXLQS

SEQ ID NO: 441 - protein, 9 aa, Artificial Sequence
  Description of Artificial Sequence: Synthetic peptide
  MOD_RES (1)..(1): Leu or Gln
  MOD_RES (3)..(3): His or Leu
  MOD_RES (4)..(4): Asn or His
  MOD_RES (5)..(5): Ser, Asn or Thr
  MOD_RES (8)..(8): Trp, Leu or Ile
XQXXXYPXT

SEQ ID NO: 442 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 443 - protein, 105 aa, Artificial Sequence
  Description of Artificial Sequence: Synthetic polypeptide
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 444 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 445 - DNA, 993 bp, Artificial Sequence
  Description of Artificial Sequence: Synthetic polynucleotide
gctagcaccaagggcccatccgtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 446 - DNA, 318 bp, Artificial Sequence
  Description of Artificial Sequence: Synthetic polynucleotide
caaccgaaagcggcgccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 447 - DNA, 321 bp, Artificial Sequence
  Description of Artificial Sequence: Synthetic polynucleotide
acggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 448 - protein, 5 aa, Artificial Sequence
  Description of Artificial Sequence: Synthetic peptide
CPSCP

SEQ ID NO: 449 - protein, 5 aa, Artificial Sequence
  Description of Artificial Sequence: Synthetic peptide
CPPCP

SEQ ID NO: 450 - protein, 6 aa, Artificial Sequence
  Description of Artificial Sequence: Synthetic 6xHis tag
HHHHHH

What is claimed:

1. An antigen binding protein, wherein said antigen binding protein is an antibody or a functional fragment thereof that agonizes human glucocorticoid-induced TNFR-related protein ("GITR"), said antigen binding protein comprising:
   a) a variant VH comprising a CDRH1, a CDRH2 and a CDRH3, wherein one or more of CDRH1, CDRH2 and CDRH3 differ in sequence relative to the corresponding CDRH1, CDRH2 and CDRH3 of the VH of any single antigen binding protein selected from the group of Ab1 to Ab59 inclusive, provided however that the sequence differences in the CDRH1, CDRH2 and CDRH3 of the variant VH relative to the corresponding CDRs of the VH sequence collectively total no more than 1, 2, 3, 4 or 5 amino acids; and
   a variant VL comprising a CDRL1, a CDRL2 and a CDRL3, wherein one or more of CDRL1, CDRL2 and CDRL3 differ in sequence relative to the corresponding CDRL1, CDRL2 and CDRL3 of the VL of any single antigen binding protein selected from the group of Ab1 to Ab59 inclusive, provided however that the sequence differences in the CDRL1, CDRL2 and CDRL3 of the variant VL relative to the corresponding CDRs of the VL sequence collectively total no more than 1, 2, 3, 4 or 5 amino acids, provided that the variant VH and the variant VL are, respectively, variants of the VH and VL of the same antigen binding protein as specified in Table 1;
   b) a VH comprising a CDRH1, a CDRH2 and a CDRH3, wherein CDRH1 comprises the sequence $X_1YGMX_2$ (SEQ ID NO:436), wherein X1 is S or N; and X2 is H or Y;
   CDRH2 comprises the sequence VIWYX₁GSNKYYADSVX₂G (SEQ ID NO:437), wherein X1 is E, V, A, P; and X2 is K or R;
   CDRH3 comprises the sequence $GGX_1LX_2X_3X_4YYX_5GMDV$ (SEQ ID NO:438), wherein X1 is Q, L, E, or R; X2 is G, R, or S; X3 is K, Y, L, F, or R; and X4 is Y or D; and X5 is Y or S; and
   a VL comprising a CDRL1, a CDRL2 and a CDRL3, wherein
   CDRL1 comprises the sequence $RASQX_1IRNDLG$ (SEQ ID NO:439), wherein X1 is G or V;
   CDRL2 comprises the sequence $X_1X_2SX_3LQS$ (SEQ ID NO:440), wherein X1 is A or D; X2 is A or T; and X3 is S or T;
   CDRL3 comprises the sequence $X_1QX_2X_3X_4YPX_5T$ (SEQ ID NO:441), wherein X1 is L or Q; X2 is H or L; X3 is N or H; X4 is S, N or T, and X5 is W, L or I;
   c) a CDRH1, a CDRH2 and a CDRH3, each from the same VH of an antigen binding protein of Ab1 to Ab59 inclusive as specified in Table 1; and
   the CDRL1, a CDRL2, and a CDRL3, each from the same VL of an antigen binding protein of Ab1 to Ab59 inclusive as specified in Table 1, wherein the VH and the VL are from the same antigen binding protein;
   d) a VH that is at least 80%, 85%, 90%, 95%, 97% or 99% identical in amino acid sequence to the VH sequence of any one of antigen binding proteins Ab1 to Ab59 inclusive as specified in Table 1; and
   a VL that is at least 80%, 85%, 90%, 95%, 97% or 99% identical in amino acid sequence to the VL sequence of any one of antigen binding proteins Ab1 to Ab59 inclusive as specified in Table 1, wherein the VH and the VL are from the same antigen binding protein as specified in Table 1;
   e) a VH comprising the amino acid sequence of the VH of any one of antigen binding proteins Ab1 to Ab59 inclusive as specified in Table 1; and
   a VL comprising the amino acid sequence of the VL of any one of antigen binding proteins Ab1 to Ab59 inclusive as specified in Table 1, wherein the VH and the VL are from the same antigen binding protein as specified in Table 1;
   f) a full length heavy chain (HC) that is at least 90%, 95%, 97% or 99% identical in amino acid sequence to the full length heavy chain sequence of any one of antigen binding proteins Ab1 to AB59 inclusive as specified in Table 1; and
   a full length light chain (LC) that is at least 90%, 95%, 97% or 99% identical in amino acid sequence to the full length light chain sequence of any one of antigen binding proteins Ab1 to Ab59 inclusive as specified in Table 1, wherein the full length heavy chain and the full length light chain are from the same antigen binding protein as specified in Table 1; or
   g) a full length heavy chain comprising the amino acid sequence of the full length heavy chain of any one of the antigen binding proteins Ab1 to Ab59 inclusive as specified in Table 1; and
   a full length light chain comprising the amino acid sequence of the full length light chain of any one of the antigen binding proteins Ab1 to Ab59 inclusive as specified in Table 1, wherein the full length heavy chain and the full length light chain are from the same antigen binding protein as specified in Table 1.

2. The antigen binding protein of claim 1, wherein the antigen binding protein comprises a CDRL1, a CDRL2, a CDRL3, a CDRH1, a CDRH2 and a CDRH3, and wherein one or more of CDRL1, CDRL2, CDRL3, CDRH1, CDRH2 and CDRH3 differ in sequence relative to the corresponding CDRL1, CDRL2, CDRL3, CDRH1, CDRH2 and CDRH3 of any single antibody selected from the group of Ab1 to Ab59 inclusive, provided however that the sequence differences in the CDRs collectively total no more than 1, 2, 3, 4, or 5 amino acids.

3. The antigen binding protein of claim 1, wherein the antigen binding protein comprises a CDRL1, a CDRL2, a CDRL3, a CDRH1, a CDRH2 and a CDRH3, and wherein:
   a) CDRL1 comprises SEQ ID NO:5, CDRL2 comprises SEQ ID NO:11, CDRL3 comprises SEQ ID NO:19, CDRH1 comprises SEQ ID NO:31, CDRH2 comprises SEQ ID NO:36 and CDRH3 comprises SEQ ID NO:47;
   b) CDRL1 comprises SEQ ID NO:5 CDRL2 comprises SEQ ID NO:12, CDRL3 comprises SEQ ID NO:18, CDRH1 comprises SEQ ID NO:31, CDRH2 comprises SEQ ID NO:40 and CDRH3 comprises SEQ ID NO:52;
   c) CDRL1 comprises SEQ ID NO:10, CDRL2 comprises SEQ ID NO:17, CDRL3 comprises SEQ ID NO:28, CDRH1 comprises SEQ ID NO:35, CDRH2 comprises SEQ ID NO:45 and CDRH3 comprises SEQ ID NO:62;
   d) CDRL1 comprises SEQ ID NO:5, CDRL2 comprises SEQ ID NO:12, CDRL3 comprises SEQ ID NO:29, CDRH1 comprises SEQ ID NO:31, CDRH2 comprises SEQ ID NO:37 and CDRH3 comprises SEQ ID NO:58;
   e) CDRL1 comprises SEQ ID NO:5, CDRL2 comprises SEQ ID NO:14, CDRL3 comprises SEQ ID NO:30, CDRH1 comprises SEQ ID NO:3, CDRH2 comprises SEQ ID NO:36 and CDRH3 comprises SEQ ID NO:63;

f) CDRL1 comprises SEQ ID NO:10, CDRL2 comprises SEQ ID NO:17, CDRL3 comprises SEQ ID NO:28, CDRH1 comprises SEQ ID NO:35, CDRH2 comprises SEQ ID NO:45 and CDRH3 comprises SEQ ID NO:76;

g) CDRL1 comprises SEQ ID NO:5, CDRL2 comprises SEQ ID NO:12, CDRL3 comprises SEQ ID NO:29, CDRH1 comprises SEQ ID NO:31, CDRH2 comprises SEQ ID NO:37 and CDRH3 comprises SEQ ID NO:58;

h) CDRL1 comprises SEQ ID NO:5, CDRL2 comprises SEQ ID NO:14, CDRL3 comprises SEQ ID NO:30, CDRH1 comprises SEQ ID NO:31, CDRH2 comprises SEQ ID NO:71 and CDRH3 comprises SEQ ID NO:63; or i) CDRL1 comprises SEQ ID NO:5, CDRL2 comprises SEQ ID NO:11, CDRL3 comprises SEQ ID NO:19, CDRH1 comprises SEQ ID NO:31, CDRH2 comprises SEQ ID NO:71 and CDRH3 comprises SEQ ID NO:47;

j) CDRL1 comprises SEQ ID NO:5, CDRL2 comprises SEQ ID NO:12, CDRL3 comprises SEQ ID NO:18, CDRH1 comprises SEQ ID NO:31, CDRH2 comprises SEQ ID NO:73 and CDRH3 comprises SEQ ID NO:52.

4. The antigen binding protein of claim 1, wherein the antigen binding protein comprises a VL and a VH, and wherein:
a) the amino acid sequence of the VL is at least 80%, 85%, 90%, 95%, 97% or 99% identical to SEQ ID NO:119 and the amino acid sequence of VH is at least 80%, 85%, 90%, 95%, 97% or 99% identical to SEQ ID NO:138;
b) the amino acid sequence of the VL is at least 80%, 85%, 90%, 95%, 97% or 99% identical to SEQ ID NO:124 and the amino acid sequence of VH is at least 80%, 85%, 90%, 95%, 97% or 99% identical to SEQ ID NO:143;
c) the amino acid sequence of the VL is at least 80%, 85%, 90%, 95%, 97% or 99% identical to SEQ ID NO:134 and the amino acid sequence of VH is at least 80%, 85%, 90%, 95%, 97% or 99% identical to SEQ ID NO:153;
d) the amino acid sequence of the VL is at least 80%, 85%, 90%, 95%, 97% or 99% identical to SEQ ID NO:135 and the amino acid sequence of VH is at least 80%, 85%, 90%, 95%, 97% or 99% identical to SEQ ID NO:154;
e) the amino acid sequence of the VL is at least 80%, 85%, 90%, 95%, 97% or 99% identical to SEQ ID NO:136 and the amino acid sequence of VH is at least 80%, 85%, 90%, 95%, 97% or 99% identical to SEQ ID NO:155;
f) the amino acid sequence of the VL is at least 80%, 85%, 90%, 95%, 97% or 99% identical to SEQ ID NO:242 and the amino acid sequence of VH is at least 80%, 85%, 90%, 95%, 97% or 99% identical to SEQ ID NO:282;
g) the amino acid sequence of the VL is at least 80%, 85%, 90%, 95%, 97% or 99% identical to SEQ ID NO:255 and the amino acid sequence of VH is at least 80%, 85%, 90%, 95%, 97% or 99% identical to SEQ ID NO:295;
h) the amino acid sequence of the VL is at least 80%, 85%, 90%, 95%, 97% or 99% identical to SEQ ID NO:262 and the amino acid sequence of VH is at least 80%, 85%, 90%, 95%, 97% or 99% identical to SEQ ID NO:302;
i) the amino acid sequence of the VL is at least 80%, 85%, 90%, 95%, 97% or 99% identical to SEQ ID NO:267 and the amino acid sequence of VH is at least 80%, 85%, 90%, 95%, 97% or 99% identical to SEQ ID NO:307;
j) the amino acid sequence of the VL is at least 80%, 85%, 90%, 95%, 97% or 99% identical to SEQ ID NO:272 and the amino acid sequence of VH is at least 80%, 85%, 90%, 95%, 97% or 99% identical to SEQ ID NO:312.

5. The antigen binding protein of claim 4, wherein the antigen binding protein comprises a VL and a VH, and wherein:
a) the VL comprises SEQ ID NO:119 and the VH comprises SEQ ID NO:138;
b) the VL comprises SEQ ID NO:124 and the VH comprises SEQ ID NO:143;
c) the VL comprises SEQ ID NO:134 and the VH comprises SEQ ID NO:153;
d) the VL comprises SEQ ID NO:135 and the VH comprises SEQ ID NO:154;
e) the VL comprises SEQ ID NO:136 and the VH comprises SEQ ID NO:155;
f) the VL comprises SEQ ID NO:242 and the VH comprises SEQ ID NO:282;
g) the VL comprises SEQ ID NO:255 and the VH comprises SEQ ID NO:295;
h) the VL comprises SEQ ID NO:262 and the VH comprises SEQ ID NO:302;
i) the VL comprises SEQ ID NO:267 and the VH comprises SEQ ID NO:307; or
j) the VL comprises SEQ ID NO:272 and the VH comprises SEQ ID NO:312.

6. The antigen binding protein of claim 1, wherein the antigen binding protein comprises a LC and HC, and wherein:
a) the LC is at least 90%, 95%, 97% or 99% identical in amino acid sequence to SEQ ID NO:317 and the HC is at least 90%, 95%, 97% or 99% identical in amino acid sequence to SEQ ID NO:336;
b) the LC is at least 90%, 95%, 9'7% or 99% identical in amino acid sequence to SEQ ID NO:322 and the HC is at least 90%, 95%, 97% or 99% identical in amino acid sequence to SEQ ID NO:341;
c) the LC is at least 90%, 95%, 97% or 99% identical in amino acid sequence to SEQ ID NO:332 and the HC is at least 90%, 95%, 97% or 99% identical in amino acid sequence to SEQ ID NO:351;
d) the LC is at least 90%, 95%, 97% or 99% identical in amino acid sequence to SEQ ID NO:333 and the HC is at least 90%, 95%, 97% or 99% identical in amino acid sequence to SEQ ID NO:352;
e) the LC is at least 90%, 95%, 97% or 99% identical in amino acid sequence to SEQ ID NO:334 and the HC is at least 90%, 95%, 97% or 99% identical in amino acid sequence to SEQ ID NO:353;
f) the LC is at least 90%, 95%, 97% or 99% identical in amino acid sequence to SEQ ID NO:360 and the HC is at least 90%, 95%, 97% or 99% identical in amino acid sequence to SEQ ID NO:400;
g) the LC is at least 90%, 95%, 97% or 99% identical in amino acid sequence to SEQ ID NO:373 and the HC is at least 90%, 95%, 97% or 99% identical in amino acid sequence to SEQ ID NO:413;
h) the LC is at least 90%, 95%, 97% or 99% identical in amino acid sequence to SEQ ID NO:380 and the HC is at least 90%, 95%, 97% or 99% identical in amino acid sequence to SEQ ID NO:420;

i) the LC is at least 90%, 95%, 97% or 99% identical in amino acid sequence to SEQ ID NO:385 and the HC is at least 90%, 95%, 97% or 99% identical in amino acid sequence to SEQ ID NO:425;

j) the LC is at least 90%, 95%, 97% or 99% identical in amino acid sequence to SEQ ID NO:390 and the HC is at least 90%, 95%, 97% or 99% identical in amino acid sequence to SEQ ID NO:430.

7. The antigen binding protein of claim 6, wherein the antigen binding protein comprises a LC and HC, and wherein:
   a) the LC comprises SEQ ID NO:317 and the HC comprises SEQ ID NO:336;
   b) the LC comprises SEQ ID NO:322 and the HC comprises SEQ ID NO:341;
   c) the LC comprises SEQ ID NO:332 and the HC comprises SEQ ID NO:351;
   d) the LC comprises SEQ ID NO:333 and the HC comprises SEQ ID NO:352;
   e) the LC comprises SEQ ID NO:334 and the HC comprises SEQ ID NO:353;
   f) the LC comprises SEQ ID NO:360 and the HC comprises SEQ ID NO:400;
   g) the LC comprises SEQ ID NO:373 and the HC comprises SEQ ID NO:413;
   h) the LC comprises SEQ ID NO:380 and the HC comprises SEQ ID NO:420;
   i) the LC comprises SEQ ID NO:385 and the HC comprises SEQ ID NO:425; or
   j) the LC comprises SEQ ID NO:390 and the HC comprises SEQ ID NO:430.

8. The antigen binding protein of claim 1, wherein the antigen binding protein has one or more of the following characteristics:
   a) is a monoclonal antibody;
   b) is a human antibody, a humanized antibody, or a chimeric antibody;
   c) is a multispecific antibody;
   d) is of the IgG1, IgG2, IgG3, or the IgG4 type;
   e) is an antigen-binding antibody fragment;
   f) is a Fab fragment, a Fab' fragment, a F(ab')2 fragment, or an Fv fragment;
   g) is a diabody, a single chain antibody, a domain antibody, or a nanobody;
   h) is labeled.

9. The antigen binding protein of claim 8 that is a fully human antibody.

10. The antigen binding protein of claim 1, that has one or more of the following activities:
   a) cross-competes with GITRL for binding to GITR;
   b) can be internalized into human CD4 cells;
   c) reduces suppression of regulatory T cells;
   d) decreases circulating regulatory T cells;
   e) activates effector T cells;
   f) has a half life of at least 6, 7, 9 or 12 days in human serum.

11. The antigen binding protein of claim 1 that is a fully human IgG1 antibody.

12. The antigen binding protein of claim 1 that is capable of binding Fcgamma receptor (FcγR).

13. The antigen binding protein of claim 12 that is capable of binding Fcgamma receptor (FcγR) such that a cluster of antigen binding proteins is formed.

14. The antigen binding protein of claim 1, wherein the antigen binding protein has one or more of the following characteristics:
   a) binds to human GITR polypeptide of SEQ ID NO:1 with a $K_D$ of less than ≤10 nM;
   b) binds to cyno GITR polypeptide of SEQ ID NO:2, with a $K_D$ of less than ≤500 nM.

15. The antigen binding protein of claim 1, wherein the antigen binding protein is a fully human monoclonal antibody of the IgG1 type that agonizes human GITR.

16. The antigen binding protein of claim 1 that binds human GITR of SEQ ID NO:1 with $K_D$≤10 nM and binds cyno GITR of SEQ ID NO:2 with $K_D$≤500 nM.

17. A method for inducing or enhancing an immune response in a subject, the method comprising administering the antigen binding protein of claim 1 to a subject in an amount effective to induce or enhance the immune response.

18. The method of claim 17, wherein the immune response is generated against a tumor antigen.

19. The method of claim 17, wherein the immune response is generated against an infectious agent.

20. The method of claim 17, wherein the antigen binding protein is administered in an amount sufficient to achieve one or more of the following in the subject:
   a) reduce regulatory T cells suppression of activity of effector T cells;
   b) decrease levels of circulating regulatory T cells;
   c) activation of effector T cells;
   d) induce or enhance effector T cell proliferation;
   e) inhibit tumor growth; and
   f) induce tumor regression.

21. A method for treating cancer in a subject with cancer, the method comprising administering an effective amount of an antigen binding protein of claim 1 to the subject.

22. The method of claim 21, wherein the cancer is a solid cancer.

23. The method of claim 21, wherein the cancer is a hematological cancer.

24. A method for inhibiting metastasis in a subject with cancer, the method comprising administering an effective amount of an antigen binding protein of claim 1 to the subject.

25. The method of claim 21, wherein the method further comprises one or more of the following
   a) administering chemotherapy;
   b) administering radiation therapy; or
   c) administering one or more additional therapeutic agents.

26. The method of claim 25, wherein the additional therapeutic agent is an immunostimulatory agent.

27. The method of claim 26, wherein the immunostimulatory agent is selected from the group consisting of talimogene laherparepvec (T-VEC), a PD1 antagonist, a PDL1 antagonist, a CTLA-4 antagonist and a Bispecific T-cell Engager (BiTE).

28. A method for treating a subject with an infection, the method comprising administering an antigen binding protein of claim 1 in an amount effective to treat the infection.

* * * * *